United States Patent 11,805,774 (SEED TREATMENT METHODS AND COMPOSITIONS FOR IMPROVING PLANT TRAITS AND YIELD) - sequence listing, part 6

SEQ ID NO: 9804 - DNA, 1472 bp, Thioclava sp. L04-15
  ref <308>: DATABASE ACCESSION NUMBER: NCBI ACCESSION: NZ_MPZW01000022.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcctaacacatgcaagtcgagcgagaccttcgggtctagcggcggacgggttagtaacgcgtgggaacgtgccctttgctacggaatagtcccgggaaactgggtttaataccgtatgtgcccttcgggggaaagatttatcggcaaaggatcggcccgcgttggattaggtagttggtggggtaacggcctaccaagccgacgatccatagctggtttgagaggatgatcagcaacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactattaagtcaggggtgaaatcccggggctcaaccccggaactgcctctgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttagtggagacactttccttcagttcggctggatcagtgacaggtgctgcatggctgtcgtcagctcgtgtcgtgagatgttcggttaagtccggcaacgagcgcaacccacgtccttagttgccatcattcagttgggcactctagggaaactgccgatgataagtcggaggaaggtgtggatgacgtcaagtcctcatggcccttacgggttgggctacacacgtgctacaatggcagtgacaatgggataatccctaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttgggtctacccgaagacggtgcgccaacctgttcgcagggggcagctggccacggtaggctcagcgactggggtgaagtcgtaacaaggtagccgtaggggaacctgcggctggatcacctcctttcta

SEQ ID NO: 9805 - DNA, 1473 bp, Thioclava sp. NG1
  ref <308>: DATABASE ACCESSION NUMBER: NCBI ACCESSION: NZ_QFBB01000024.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcgagcgagatcttcggatctagcggcggacgggtgagtaacgcgtggggatgtgccctttgctacggaatagtcccgggaaactgggtttaataccgtatgtgcccttcgggggaaagatttatcggcaaaggatcaacccgcgttggattaggtagttggtggggtaatggcctaccaagccgacgatccatagctggtttgagaggatgatcagccacactgggactgagacacggcccagactcctacgggaggcagcagtggggaatcttagacaatgggggaaaccctgatctagccatgccgcgtgagcgatgaaggccttagggttgtaaagctctttcagctgggaagataatgacggtaccagcagaagaagccccggctaactccgtgccagcagccgcggtaatacggagggggctagcgttgttcggaattactgggcgtaaagcgcacgtaggcggactattaagtcaggggtgaaatcccggggctcaaccccggaactgcctctgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagtcgtcgggttgcatgcaattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccagagatggtttccttcagttcggctggatcagtgacaggtgctgcatggctgtcgtcagctcgtgtcgtgagatgttcggttaagtccggcaacgagcgcaacccacgtccttagttgccatcattcagttgggcactctagggaaactgccgatgataagtcggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaagatggtgcgccaacctgttcgcagggggcagctagccacggtaggatcagcgactggggtgaagtcgtaacaaggtagccgtaggggaacctgcggctggatcacctcctttctaa

SEQ ID NO: 9806 - DNA, 1469 bp, Thioclava sp. SK-1
  ref <308>: DATABASE ACCESSION NUMBER: NCBI ACCESSION: NZ_MDHA01000012.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcgagattttcggatctagcggcggacgggttagtaacgcgtgggaatgtacccttcactacggaatagtcccgggaaactgggtttaataccgtatacgcccttcgggggaaagaatttcggtgaaggatcagcccgcgttagattagatagttggtggggtaatggcctaccaagtctacgatctatagctggtttgagaggatgatcagcaacactgggactgagacacggcccagactcctacgggaggcagcagtggggaatcttagacaatgggcgcaagcctgatctagccatgccgcgtggatgatgaaggccttagggttgtaaagtcctttcagtcgtgaagataatgacggtagcgacagaagaagccccggctaactccgtgccagcagccgcggtaatacggagggggctagcgttgttcggaattactgggcgtaaagcgcacgtaggcggattaataagtcgggggtgaaatcccggggctcaaccccggaactgcctccgatactgttagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggtagcatgctattcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatgggtatcgcggaaccagagatggttctttcagttcggctggataccacacaggtgctgcatggctgtcgtcagctcgtgtcgtgagatgttcggttaagtccggcaacgagcgcaacccacgtccttagttgccagcagttcggctgggcactctagggaaactgccgatgataagtcggaggaaggtgtggatgacgtcaagtcctcatggcccttacgggttgggctacacacgtgctacaatggcatcaacaatgggttaatccctaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacgacgctgcgctaacccttcggggaggcaggcggccacggtaggatcagcgactggggtgaagtcgtaacaaggtagccgtaggggaacctgcggctggatcacctcctttctaa

SEQ ID NO: 9807 - DNA, 1531 bp, Thiocystis violascens
  ref <308>: DATABASE ACCESSION NUMBER: NCBI ACCESSION: NC_018012.1
  ref <309>: DATABASE ENTRY DATE: 2019-04-01
  ref <313>: RELEVANT RESIDUES IN SEQ ID NO: (1)..(1531)
ttgaactgaagagtttgatcctggctcagattgaacgctggcggcatgcctaacacatgcaagtcgaacgcgaaaaggctttggcctgagtagcgtggcggacgggtgagtaatgcgtgggaatctgcctggcagtgggggataacccggggaaactcgggctaataccgcatacgccctacgggggaaagggggcttcggctctcgttgccagatgagcccacgtccgattagcttgttggcggggtaacggcccaccaaggccgcgatcggtcgctggtctgagaggatgaccagccacactgggactgagacacggcccagactcctacgggaggcagcagtggggaatattggacaatgggcgcaagcctgatccagcaatgccgcgtgtgtgaagaaggcctgcgggttgtaaagcactttcagtgggaaagaaaagcggctggttaatacccagtcgtcttgacgttactcacaaaagaagcaccggctaactccgtgccagcagccgcggtaatacggagggtgcaagcgttaatcggaattactgggcgtaaagcgcgcgtaggcggcccggtcagtccgctgtgaaagccctgggcttaacctgggaactgcagtggatactgccgcgctagagtgtgaaagaggggggtggaattccaggtgtagcggtgaaatgcgtagagatctggaggaacaccagtggcgaaggcggccccctggttcaacactgacgctgaggtgcgaaagcgtggggagcaaacaggattagataccctggtagtccacgcggtaaacgatgtcgactagccgtggggtccatttaagggcttcgtggcgcagctaacgcgataagtcgaccgcctggggagtacggccgcaaggttaaaactcaaaggaattgacgggggcccgcacaagcggtggagcatgtggtttaattcgatgcaacgcgaagaaccttaccagcccttgacatcctcggaatcctgcggagacgcgggagtgccttcgggagccgagagacaggtgctgcatggctgtcgtcagctcgtgtcgtgagatgttgggttaagtcccgtaacgagcgcaacccttgtccttagttgccagcgcgtcatggcgggaactctaaggagactgccggtgataaaccggaggaaggtggggatgacgtcaagtcatcatggcccttatgggctgggctacacacgtgctacaatggccggtacagagggttgcgagcccgcgagggggagccaatcccagaaaaccggtcgtagtccggatcgcagtctgcaactcgactgcgtgaagtcggaatcgctagtaatcgcgaatcagcatgtcgcggtgaatacgttcccgggccttgtacacaccgcccgtcacaccatgggagttggttgcaccagaagtcgatagcctaaccttcgggagggcgttgaccacggtgtggtcaatgactggggtgaagtcgtaacaaggtagccgtaggggaacctgcggctggatcacctcctta

SEQ ID NO: 9808 - DNA, 1540 bp, Thioflavicoccus mobilis
  ref <308>: DATABASE ACCESSION NUMBER: NCBI ACCESSION: NC_019940.1
  ref <309>: DATABASE ENTRY DATE: 2019-04-01
  ref <313>: RELEVANT RESIDUES IN SEQ ID NO: (1)..(1540)
ttgaactgaagagtttgatcctggctcagattgaacgctggcggcatgcttaacacatgcaagtcgaacgcgaaagggcttcggcctgagtagagtggcggacgggtgagtaacgcgtgggaatctgccctgtagtgggggacaacctggggaaactcgggctaataccgcatacgtcctacgggagaaagggggcctctgcttgcaagctcctgctagaggatgagcccacgtccgattagctagttggtggggtaaaggcccaccaaggcgacgatcggtagctggtctgagaggatgatcagccacactgggactgagacacggcccagactcctacgggaggcagcagtggggaatattggacaatgggcgcaagcctgatccagcaatgccgcgtgtgtgaagaaggcctgcgggttgtaaagcactttcagtggggaagaaaggcctggggtgaatagccctgggtgttgacgttacccacagaagaagcaccggctaactccgtgccagcagccgcggtaatacggagggtgcaagcgttaatcggaatcactgggcgtaaagggcgcgtaggcggcgaggtaagtcagatgtgaaatccccgggctcaacctgggaatggcatttgatactgctttgctagagtctggtagaggggggtggaattccaggtgtagcggtgaaatgcgtagagatctggaggaacaccagtggcgaaggcgaccccctgggccaagactgacgctgaggtgcgaaagcgtggggagcaaacaggattagataccctggtagtccacgctgtaaacgctgtcgactagccgttggatccaattaagggttgagtggcgcagctaacgcgataagtcgaccgcctggggagtacggccgcaaggttaaaactcaaaggaattgacgggggcccgcacaagcggtggagcatgtggtttaattcgatgcaacgcgaagaaccttaccagcccttgacatcctcggaatcctgcagagatgtgggagtgccttcgggagccgagagacaggtgctgcatggctgtcgtcagctcgtgtcgtgagatgttgggttaagtcccgtaacgagcgcaacccttgtccttagttgccagcggttcggccgggaactctaaggagactgccggtgataaaccggaggaaggtggggatgacgtcaagtcatcatggcccttatgggctgggctacacacgtgctacaatggtcggtacagagggttgcgaagcggcgacgtggagccaatcccagaaaaccggtcgtagtccggattgcagtctgcaactcgactgcatgaagtcggaatcgctagtaatcgcgaatcagcatgtcgcggtgaatacgttcccgggccttgtacacaccgcccgtcacaccatgggagttggttgcaccagaagtcgatagcttaaccttcgggagggcgttgaccacggtgtgatcaatgactggggtgaagtcgtaacaaggtagccgtaggggaacctgcggctggatcacctccttaaa

SEQ ID NO: 9809 - DNA, 1507 bp, Thiohalobacter thiocyanaticus
  ref <308>: DATABASE ACCESSION NUMBER: NCBI ACCESSION: NZ_QZMU01000001.1
  ref <309>: DATABASE ENTRY DATE: 2019-04-01
  ref <313>: RELEVANT RESIDUES IN SEQ ID NO: (1)..(1507)
aaactgaagagtttgatcctggctcagattgaacgctggcggcatgcttaacacatgcaagtcgaacggtaacaggcgggagcttgctcctgcgctgacgagtggcggacgggtgagtaatacgtaggaatctgcccagtagtgggggacaacctggggaaactcaggctaataccgcatacgccctacgggggaaaggcttcggccgctattggatgagcctacgtccgattagcttgttggtggggtaacggcccaccaaggcgacgatcggtagctggtctgagaggacgatcagccacactgggactgagacacggcccagactcctacgggaggcagcagtggggaatattggacaatgggggaaaccctgatccagcaatgccgcgtgtgtgaagaaggcctgcgggttgtaaagcactttcagcagggaagattatgacggtacctgcagaagaagcaccggctaactccgtgccagcagccgcggtaatacggagggtgcaagcgttaatcggaattactgggcgtaaagcgcgcgtaggcggcttggtaagtcggatgtgaaagccccgggctcaacctgggaattgcattcgatactgcctggctagagtctggtagagggtggcggaattcccggtgtagcggtgaaatgcgtagatatcgggaggaacatcagtggcgaaggcggccacctggaccaagactgacgctgaggtgcgaaagcgtggggagcaaacaggattagataccctggtagtccacgccgtaaacgatgtcaactagccgttggattcatttaagaatttagtggcgcagctaacgcgataagttgaccgcctggggagtacggccgcaaggttaaaactcaaaggaattgacgggggcccgcacaagcggtggagcatgtggtttaattcgatgcaacgcgaagaaccttacctgcccttgacatcctcggaacttgtcagagatgacttggtgccttcgggaaccgagtgacaggtgctgcatggctgtcgtcagctcgtgtcgtgagatgttgggttaagtcccgcaacgagcgcaacccttgtccttagttgccagcattcagttgggcactctaaggagactgccggtgacaaaccggaggaaggtggggatgacgtcaagtcatcatggcccttatgggcagggctacacacgtgctacaatggacggtacagagggtcgccaacccgcgagggggagctaatcccgaaaagccgttcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtggatagtctaaccttcgggaggacgttcaccacggtgtgattcatgactggggtgaagtcgtaacaaggtagccgtaggggaacctgcggctggatcacctcctttaa

SEQ ID NO: 9810 - DNA, 1548 bp, Thiomicrorhabdus sp. HaS4
  ref <308>: DATABASE ACCESSION NUMBER: NCBI ACCESSION: NZ_AP018722.1
  ref <309>: DATABASE ENTRY DATE: 2019-04-01
  ref <313>: RELEVANT RESIDUES IN SEQ ID NO: (1)..(1548)
taaactgaagagtttgatcctggctcagaatgaacgctggcggtaggcttaacacatgcaagtcggacggtagcaggagataagtttacttattttgctgacgagtggcggacgggtgagtaacgcgtgggaatctaccctatagttggggacaacgtatggaaacgtacgctaataccgaatatgctctacggagtaaaggagccctcttcatgaaaggtttcgctataggatgagcccgcgtaagattagctagttggtgaggtaatggctcaccaaggcgacgatctttagctggtttgagaggatgatcagccacactgggactgagacacggcccagactcctacgggaggcagcagtggggaatattggacaatggacgaaagtctgatccagccataccgcgtgtgtgaagaaggccttcgggttgtaaagcactttcagttgggaggaagattaagtagttaatacctgcttagtttgacgttaccttcagaagaagcaccggctaactctgtgccagcagccgcggtaatacagagggtgcaagcgttattcggaattactgggcgtaaagcgcgcgtaggcggattagtaagtcagttgtgaaagccctgggctcaacctaggaactgcatctgatactgctagtctagagtttagtagagggaaggggaattccaggtgtagcagtgaaatgcgtagatatctggaggaacatcagtggcgaaggcgccttcctggactaaaactgacgctgaggtgcgaaagcgtgggtagcgaacgggattagataccccggtagtccacgccgtaaacgatgtcaactagttgttggtcttattaaaaagattagtaacgaagctaacgcgataagttgaccgcctggggagtacggtcgcaagattaaaactcaaaggaattgacgggggcccgcacaagcggtggagcatgtggtttaattcgatgcaacgcgaagaaccttaccatcccttgacatgtagagaattttccagagatggagaagtgccttcgggaactctaacacaggtgctgcatggctgtcgtcagctcgtgtcgtgagatgttgggttaagtcccgcaacgagcgcaacccttatcattagttgctaccatttagttgagaactctaatgagactgccggtgataaaccggaggaaggcggggacgacgtcaagtcatcatggcccttatgggatgggctacacacgtgctacaatggggagtacaaagagcagccaactggcgacagtgcgcgaatctcaaaaaacttctcgtagtccggattggagtctgcaactcgactccatgaagtcggaatcgctagtaatcgcgaatcagaatgtcgcggtgaatacgttcccgggccttgtacacaccgcccgtcacaccatgggagtggattgcaaaagaagtaggtagcttaaccttcgggagggcgcttaccactttgtggttcatgactggggtgaagtcgtaacaaggtagccctagcggaagctggggctggatcacctccttta

SEQ ID NO: 9811 - DNA, 1563 bp, Thiomicrospira sp. S5
  ref <308>: DATABASE ACCESSION NUMBER: NCBI ACCESSION: NZ_CP014470.1
  ref <309>: DATABASE ENTRY DATE: 2019-04-01
  ref <313>: RELEVANT RESIDUES IN SEQ ID NO: (1)..(1563)
taaactgaagagtttgatcctggctcagaatgaacgctggcggcaggcctaacacatgcaagtcgaacggaaacgacaagaacaaactcttcggagggcgatcttgggcgtcgagtggcggacgggtgagtaacgcgtgggaatctaccctttagttggggacaacatatggaaacgtatgctaataccgaatatgctctacggagtaaaggtggcctctacttgtaagctatcgctaaaggatgagcccgcgttagattagctagttggtggggtaaaggcctaccaaggcgacgatctatagctggtttgagaggatgatcagccacactgggactgagacacggcccagactcctacgggaggcagcagtggggaatattgcacaatgagggaaaccttgatgcagccatgccgcgtgtgtgaagaaggcccgagggttgtaaagcactttcaattgtgaggaaaggttagtcgctaatatcggctagctgtgacgttaactttagaagaagcaccggctaactctgtgccagcagccgcggtaatacagagggtgcaagcgttattcggaattactgggcgtaaagcgcgcgtaggcggactgttaagtcggttgtgaaagccctgggctcaacctaggaattgcatccgatactggcaatctagagtttaggagagggaagtggaattcctggtgtagcagtgaaatgcgtagatatcaggaggaacatcagtggcgaaggcgacttcctggcctaaaactgacgctgaggtgcgaaagcgtgggtagcgaacgggattagataccccggtagtccacgccgtaaacgatgtcaactagctgttggccttattaaaaaggttagtagcgtagctaacgcgctaagttgaccgcctgggggagtacggtcgcaagattaaaactcaaaggaattgacgggggcccgcacaagcggtggagcatgtggtttaattcgatgcaacgcgaagaaccttaccatcccttgacatcctgcgaactttctagagatagattggtgccttcgggaacgcagtgacaggtgctgcatggctgtcgtcagctcgtgtcgtgagatgttgggttaagtcccgcaacgagcgcaacccttatctttagttgctaccatttagttgagaactctaaagagactgccggtgataaaccggaggaaggcggggacgacgtcaagtcatcatggcccttatgggatgggctacacacgtgctacaatggggggtacaaagagcagctagctggcgacagtgcgcgaatctcataaaacctctcgtagtccggatcggagtctgcaactcgactccgtgaagtcggaatcgctagtaatcgtgaatcagaatgtcacggtgaatacgttcccgggccttgtacacaccgcccgtcacaccatgggagtgggttgcaaaagaagtgggtagtctaaccttcgggagggcgctcaccactttgtgattcatgactggggtgaagtcgtaacaaggtagccctagcggaagctggggctggatcacctcctttaagac

SEQ ID NO: 9812 - DNA, 1539 bp, Thiomonas delicata
  ref <308>: DATABASE ACCESSION NUMBER: NCBI ACCESSION: NZ_LT592170.1
  ref <309>: DATABASE ENTRY DATE: 2019-04-01
  ref <313>: RELEVANT RESIDUES IN SEQ ID NO: (1)..(1539)
agattaaactgtagagtttgatcctggctcagattgaacgctagcggcatgccttacacatgcaagtcgaacggcagcacgggggcaaccctggtggcgagtggcgaacgggtgagtaatgcatcggaacgtgcccatcgatgggggataactgcgcgaaagcgttgctaataccgcatacgacctacgggtgaaagcaggggaccgcaaggccttgcgtcgatggagcggccgatgccggattagctagttggtgaggtaaaggctcaccaaggcaacgatccgtagctggtctgagaggacgaccagccacactgggactgagacacggcccagactcctacgggaggcagcagtggggaatcttggacaatgggcgaaagcctgatccagcaatgccgcgtgtgggaagaaggccttcgggttgtaaaccacttttggcgggaaagaaatggtctgtgctaataccacggattgatgacggtacccgcagaataagcaccggctaactacgtgccagcagccgcggtaatacgtagggtgcgagcgttaatcggaattactgggcgtaaagcgtgcgcaggcggttgggaaagatagatgtgaaagccctgggctcaacctaggaattgcatttatgactgcccgactggagtacggtagaggggagtggaattccgcgtgtagcagtgaaatgcgtagatatgcggaggaacaccgatggcgaaggcagctccctggacctgtactgacgctcatgcacgaaagcgtggggagcaaacaggattagataccctggtagtccacgccctaaacgatgtcgactggttgttggacgggaaactgttcagtaacgaagctaacgcgtgaagtcgaccgcctggggagtacggccgcaaggttaaaactcaaaggaattgacggggacccgcacaagcggtggatgatgtggtttaattcgatgcaacgcgaaaaaccttacctacccttgacatgtctggaatcccgaagagatttgggagtgctcgaaagagagccagaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcatcatggcccttatgggtagggctacacacgtcatacaatggacggtacagagggttgccaacccgcgagggggagccaatcccataaaaccgttcgtagtccggattgcagtctgcaactcgactgcatgaagtcggaatcgctagtaatcgcggatcagcttgccgcggtgaatacgttcccgggtcttgtacacaccgcccgtcacaccatgggagtggggtttaccagaagtagttagcctaaccgcaaggagggcgattaccacggtaggcttcatgactggggtgaagtcgtaacaaggtagccgtatcggaaggtgcggctggatcacctcctttctg

SEQ ID NO: 9813 - DNA, 1539 bp, Thiomonas sp. X19
  ref <308>: DATABASE ACCESSION NUMBER: NCBI ACCESSION: NZ_LT605203.1
  ref <309>: DATABASE ENTRY DATE: 2019-04-01
  ref <313>: RELEVANT RESIDUES IN SEQ ID NO: (1)..(1539)
agattgaactgtagagtttgatcctggctcagattgaacgctagcggcatgccttacacatgcaagtcgaacggcagcacgggggcaaccctggtggcgagtggcgaacgggtgagtaatgcatcggaacgtgcccattgatgggggataactgcgcgaaagcgttgctaataccgcatacgacctacgggtgaaagcaggggaccgcaaggccttgcgtcgatggagcggccgatgtcggattagcttgttggtgaggtaaaggctcaccaaggcgacgatccgtagctggtctgagaggacgaccagccacactgggactgagacacggcccagactcctacgggaggcagcagtggggaatcttggacaatgggcgaaagcctgatccagcaatgccgcgtgtgggaagaaggccttcgggttgtaaaccacttttggcaggaaagaaatcgtttgcgataataccgcgaatggatgacggtacctgcagaataagcaccggctaactacgtgccagcagccgcggtaatacgtagggtgcgagcgttaatcggaattactgggcgtaaagcgtgcgcaggcggttggaaaagatagatgtgaaatccctgggctcaacctaggaattgcatttatgactatccgactagagtacggtagaggggagtggaattccgcgtgtagcagtgaaatgcgtagatatgcggaggaacaccgatggcgaaggcagctccctggacctgtactgacgctcatgcacgaaagcgtggggagcaaacaggattagataccctggtagtccacgccctaaacgatgtcgactagttgttggacgggaaactgttcagtaacgaagctaacgcgtgaagtcgaccgcctggggagtacggccgcaaggttaaaactcaaaggaattgacggggacccgcacaagcggtggatgatgtggtttaattcgatgcaacgcgaaaaaccttacctacccttgacatgtctggaatcctgaagagatttaggagtgctcgaaagagagccagaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcatcatggcccttatgggtagggctacacacgtcatacaatggacggtacagagggttgccaacccgcgagggggagctaatcccataaaaccgttcgtagtccggattgcagtctgcaactcgactgcatgaagtcggaatcgctagtaatcgcggatcagcttgccgcggtgaatacgttcccgggtcttgtacacaccgcccgtcacaccatgggagtggggtttaccagaagtagttagcctaaccgcaaggagggcgattaccacggtaggcttcatgactggggtgaagtcgtaacaaggtagccgtatcggaaggtgcggctggatcacctcctttctg

SEQ ID NO: 9814 - DNA, 1533 bp, Thiorhodococcus drewsii
  ref <308>: DATABASE ACCESSION NUMBER: NCBI ACCESSION: NZ_AFWT01000001.1
  ref <309>: DATABASE ENTRY DATE: 2019-04-01
  ref <313>: RELEVANT RESIDUES IN SEQ ID NO: (1)..(1533)
ttgaactgaagagtttgatcctggctcagattgaacgctggcggcatgcttaacacatgcaagtcgaacgcgaaagtccttcggggcgagtagagtggcggacgggtgagtaatgcgtgggaatctgcctggcagtgggggataacccgaggaaactcgggctaataccgcatacgccctacgggggaaagggggcttcggctctcgttgctagatgagcccacgtccgattagctagttggtggggtaaaggcccaccaaggcgacgatcggtagctggtctgagaggatgatcagccacactgggactgagacacggcccagactcctacgggaggcagcagtggggaatattggacaatgggcgcaagcctgatccagcaatgccgcgtgtgtgaagaaggcctgcgggttgtaaagcactttcagtgaggaagaaaagcctggggttaatacccctgggtcttgacgttactcacagaagaagcaccggctaactccgtgccagcagccgcggtaatacggagggtgcaagcgttaatcggaatcactgggcgtaaagcgcacgtaggcggcttggtcagtcagctgtgaaagccctgggcttaacctgggaactgcagttgatactgcctagctagagtctgaaagaggggggtggaattccaggtgtagcggtgaaatgcgtagatatctggaggaacaccagtggcgaaggcggccccctggttcaagactgacgctgaggtgcgaaagcgtggggagcaaacaggattagataccctggtagtccacgctgtaaacgctgtcgactagccgtggggctcatttaagggtttcgtggcgcagctaacgcgataagtcgaccgcctggggagtacggccgcaaggttaaaactcaaaggaattgacgggggcccgcacaagcggtggagcatgtggtttaattcgatgcaacgcgaagaaccttaccagcccttgacatcctcgggacttggcagagatgccttggtgccttcgggagccgagagacaggtgctgcatggctgtcgtcagctcgtgtcgtgagatgttgggttaagtcccgtaacgagcgcaacccttgtccttagttgccagcgagtcaagtcgggaactctaaggagactgccggtgataaaccggaggaaggtggggatgacgtcaagtcatcatggcccttatgggctgggctacacacgtgctacaatggccggtacagagggtcgcaagcccgcgagggggagccaatctcagaaaaccggtcgtagtccggatcgcagtctgcaactcgactgcgtgaagtcggaatcgctagtaatcgcgaatcagaatgtcgcggtgaatacgttcccgggccttgtacacaccgcccgtcacaccatgggagttggttgcaccagaagtagatagcttaaccttcgggagggcgtttaccacggtgtggtcaatgactggggtgaagtcgtaacaaggtagccgtaggggaacctgcggctggatcacctccttact

SEQ ID NO: 9815 - DNA, 1534 bp, Thiorhodovibrio sp. 970
  ref <308>: DATABASE ACCESSION NUMBER: NCBI ACCESSION: NZ_JH603170.1
  ref <309>: DATABASE ENTRY DATE: 2019-04-01
  ref <313>: RELEVANT RESIDUES IN SEQ ID NO: (1)..(1534)
ttgaactgaagagtttgatcctggctcagattgaacgctggcggcatgcctaacacatgcaagtcgaacgcgaaagcccttcggggtgagtagagtggcggacgggtgagtaaagcgtgggaatctgccctgcagtgggggacaacccggggaaacccgggctaataccgcatgcgacctacgggtgaaagggggctctttgagctctcgctgcaggatgagctcacgtccgattagctagttggtggggtaaaggcccaccaaggcgacgatcggtagctggtctgagaggatgatcagccacactgggactgagacacggcccagactcctacgggaggcagcagtggggaatattggacaatgggggaaaccctgatccagcaatgccgcgtgtgtgaagaaggcctgcgggttgtaaagcactttcagtggggaagaacaggagtgtgttaataccacattcacttgacgttacccacagaagaagcaccggctaactccgtgccagcagccgcggtaatacggagggtgcaagcgttaatcggaatcactgggcgtaaagcgcgcgtaggcggctcagtcagtcagatgtgaaagccccgggcttaacctgggaacggcatttgatactgctgggcttgagtctggtagaggggggtggaattccaggtgtagcggtgaaatgcgtagatatctggaggaacaccggtggcgaaggcgaccccctggaccaagactgacgctgaggtgcgaaagcgtggggagcaaacaggattagataccctggtagtccacgctgtaaacgatgtcgactagccgttgggttcatttaagaatttagtggcgcagctaacgcgataagtcgaccgcctggggagtacggccgcaaggttaaaactcaaaggaattgacgggggcccgcacaagcggtggagcatgtggtttaattcgatgcaacgcgaagaaccttaccagcccttgacatcctcggaacttagcagagatgctttggtgccttcgggagccgagagacaggtgctgcatggctgtcgtcagctcgtgtcgtgagatgttgggttaagtcccgtaacgagcgcaacccttgtccttagttgccagcggttcggccgggaactctaaggagactgccggtgataaaccggaggaaggtggggatgacgtcaagtcatcatggcccttatgggctgggctacacacgtgctacaatggccggtacagagggttgcgaagccgcgaggtggagccaatcccagaaaaccggtcgtagtccggattgcagtctgcaactcgactgcatgaagtcggaatcgctagtaatcgcgaatcagcatgtcgcggtgaatacgttcccgggccttgtacacaccgcccgtcacaccatgggagttggttgcaccagaagtagatagcttaaccttcgggagggcgtttaccacggtgtgatcaatgactggggtgaagtcgtaacaaggtagccgtaggggaacctgcggctggatcacctccttaa

SEQ ID NO: 9816 - DNA, 1534 bp, Tibeticola sediminis
  ref <308>: DATABASE ACCESSION NUMBER: NCBI ACCESSION: NZ_RKQL01000004.1
  ref <309>: DATABASE ENTRY DATE: 2019-04-01
  ref <313>: RELEVANT RESIDUES IN SEQ ID NO: (1)..(1534)
gaactgaagagtttgatcctggctcagattgaacgctggcggaatgctttacacatgcaagtcgaacggcagcacgggggcaaccctggtggcgagtggcgaacgggtgagtaatacatcggaacgtgcccggtcgtgggggataacgtagcgaaagttacgctaataccgcatacgatctgaggatgaaagcgggggaccttcgggcctcgcgcgatcggagcggccgatgtcagattaggtagttggtggggtaaaggcctaccaagccgacgatctgtagctggtctgagaggacgaccagccacactgggactgagacacggcccagactcctacgggaggcagcagtggggaattttggacaatgggcgcaagcctgatccagccattccgcgtgcaggatgaaggccttcgggttgtaaactgcttttgtacggaacgaaaaggctctggctaatacctggggctcatgacggtaccgtaagaataagcaccggctaactacgtgccagcagccgcggtaatacgtagggtgcgagcgttaatcggaattactgggcgtaaagcgtgcgcaggcggttatgtaagacagaggtgaaatccccgggctcaacctgggaactgcctttgtgactgcatgactagagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttggctgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaaccctttggagacagaggggtgctcgaaagagagccgtaacacaggtgctgcatggctgtcgtcagctcgtgtcgtgagatgttgggttaagtcccgcaacgagcgcaacccttgccattagttgctacgaaagggcactctaatgggactgccggtgacaaaccggaggaaggtggggatgacgtcaagtcctcatggcccttataggtggggctacacacgtcatacaatggctggtacagagggttgccaacccgcgagggggagccaatcccagaaaaccagtcgtagtccggatcgcagtctgcaactcgactgcgtgaagtcggaatcgctagtaatcgcggatcagaatgtcgcggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 9817 - DNA, 1569 bp, Tissierellia bacterium S5-A11
  ref <308>: DATABASE ACCESSION NUMBER: NCBI ACCESSION: NZ_JRMZ01000096.1
  ref <309>: DATABASE ENTRY DATE: 2019-04-01
  ref <313>: RELEVANT RESIDUES IN SEQ ID NO: (1)..(1569)
atggagagtttgatcctggctcaggacgaacgctggcggcgtgcctaacacatgcaagtcgaacggagagatacgagagcttgctcttgtaaatcttagtggcaaacgggtgagtaacgcgtaaacaacctgcccaacggatggggacaacagacggaaacgactgctaatacccaatagactccggtttcgcatgaaaccgacaggaaaggtggcctctcgaagaagctaccgccgcaggaggggtttgcgtttgattagttagttggtggggtaacggcctaccaagacgatgatcaatagccggtctgagaggatgaacggccacactggaactgagacacggtccagactcctacgggaggcagcagtggggaatcttccgcaatggacgaaagtctgacggagcaacgccgcgtgagtgaagaaggccttcgggttgtaaagctctgttattcgggaagaacgattcgtttgtgaacaatgaacggaagtgacggtaccgaaagagaaagccacggctaactacgtgccagcagccgcggtaatacgtaggtggcaagcgttgtccggaattattgggcgtaaagagcgcgtaggcggtatgataagtctgtcttagaagtgcggggcttaaccccgtgaggggacagagactgtcatactagagtctcggagaggaaagcggaattcctagtgtagcggtgaaatgcgtagagattaggaagaacaccggtggcgaaggcggctttctggacgagcactgacgctgaggcgcgaaagcgtggggagcgaacaggattagataccctggtagtccacgccgtaaacgatgggtactaggtgtaggaggtatcgaccccttctgtgccggagttaacgcaataagtaccccgcctggggagtacggtcgcaagattaaaactcaaaggaattgacgggggcccgcacaagcggtggagtatgtggtttaattcgacgcaacgcgaagaaccttaccaggtcttgacattgatcgcaatccgcagagacgcggagttctccttcgggagacgagaaaacaggtggtgcacggctgtcgtcagctcgtgtcgtgagatgttgggttaagtcccgcaacgagcgcaacccctatcttcaattaccagcacgtcatggtggggactatggagagactgccgatgacaaatcggaggaaggcggggatgacgtcaagtcatcatgccccttatgacctgggctacacacgtactacaatggtcctgacagagagcagcgaagtggcgacaccaagcgaacctcagaaacaggatcccagttcggatcgcaggctgcaactcgcctgcgtgaagcaggaatcgctagtaatcgcgggtcagcataccgcggtgaatacgttcccgggccttgtacacaccgcccgtcacaccacgagagtggggaacacccgaagccggtgggagaaccgtaaggactcagccgtcgaaggtgggcttcatgattggggtgaagtcgtaacaaggtagccgtaccggaaggtgcggctggatcacctcctttctaaggaga

SEQ ID NO: 9818 - DNA, 1543 bp, Tolypothrix campylonemoides
  ref <308>: DATABASE ACCESSION NUMBER: NCBI ACCESSION: NZ_JXCB01000041.1
  ref <309>: DATABASE ENTRY DATE: 2019-04-01
  ref <313>: RELEVANT RESIDUES IN SEQ ID NO: (1)..(1543)
taagtgaagagtttgatcctggctcagagtgaacgctggcggcaggcctaacacatgcaagtcgaacggcagcacagtcccgcaagggatgggtggcgagtggcggacgggtgaggaatgcatcggaatctgcctcgtcgtgggggataacgtagggaaacttacgctaataccgcatacgtcctacgggagaaagtgggggatcgcaagacctcacgcgatgagatgagccgatgccggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgtccggaaagaaatcgtgccggttaatacccggcgcggatgacggtaccggaagaataagcaccggctaacttcgtgccagcagccgcggtaatacgaagggtgcaagcgttactcggaattactgggcgtaaagcgtgcgtaggtggtggtttaagtccgatgtgaaagccctgggctcaacctgggaatggcatgggatactggactgctggagtgcggtagaggatggcggaattcccggtgtagcagtgaaatgcgtagatatcgggaggaacatccgtggcgaaggcggccatctggaccagcactgacactgaggcacgaaagcgtggggagcaaacaggattagataccctggtagtccacgccctaaacgatgcgaactggatgttgggtgcaactaggcactcagtatcgaagctaacgcgttaagttcgccgcctgggaagtacggtcgcaagactgaaactcaaaggaattgacgggggcccgcacaagcggtggagtatgtggtttaattcgatgcaacgcgcagaaccttacctggccttgacatccacggaaccttgcagagatgcgagggtgccttcgggaaccgtgagacaggtgctgcatggctgtcgtcagctcgtgtcgtgagatgttgggttaagtcccgcaacgagcgcaacccttgtccttagttgccagcacgtaaaggtgggaactctaaggagaccgccggcgacaagccggaggaaggtggggatgacgtcaagtcatcatggcccttacggccagggctacacacgtactacaatggtggggacagagggccgcgatgccgcgaggcggagccaatcccagaaaccccatctcagtccggatcggagtctgcaactcgactccgtgaagtcggaatcgctagtaatcgcagatcagcattgctgcggtgaatacgttcccgggccttgtacacaccgcccgtcacaccatgggagtttgttgcaccagaagcaggtagcttaaccgcaaggggggcgcttgccacggtgtggccgatgactggggtgaagtcgtaacaaggtagccgtatcggaaggtgcggctggatcacctccttt

SEQ ID NO: 9819 - DNA, 1490 bp, Tolypothrix sp. PCC 7601
  ref <308>: DATABASE ACCESSION NUMBER: NCBI ACCESSION: NZ_JH930360.1
  ref <309>: DATABASE ENTRY DATE: 2019-04-01
  ref <313>: RELEVANT RESIDUES IN SEQ ID NO: (1)..(1490)
aaaatggagagtttgatcctggctcaggatgaacgctggcggtatgcttaacacatgcaagtcgaacggtctcttcggagatagtggcggacgggtgagtaacgcgtgagaatctagcttcaggtcggggacaaccactggaaacggtggctaataccggatgtgccgagaggtaaaaggcttgctgcctgaagatgagctcgcgtctgattagctagtaggtgtggtaagagcgcacctaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcaaggaagaaaaaaatgacggtacttgaggaataagcatcggctaactccgtgccagcagccgcggtaatacggaggatgcaagcgttatccggaatgattgggcgtaaagcgtccgcaggtggcaatgtaagtctgctgttaaagagtgaggctcaacctcataagagcagtggaaactacatagctagagtgcgttcggggcagagggaattcctggtgtagcggtgaaatgcgtagagatcaggaagaacaccggtggcgaaagcgctctgctaggccgcaactgacactgagggacgaaagctaggggagcgaatgggattagataccccagtagtcctagccgtaaacgatggatactaggcgtggcttgtatcgacccgagccgtgccggagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatcctcttgaaagggaggagtgccttcgggagcgcgaacacaggtggtgcatggctgtcgtcagctcgtgtcgtgagatgttgggttaagtcccgcaacgagcgcaaccctcgtttttagttgccagcattaagttgggcactctagagagactgccggtgacaaaccggaggaaggtggggatgacgtcaagtcagcatgccccttacgtcttgggctacacacgtactacaatgctacggacaaagggcagcgagctagcgatagcaagcaaatctcataaaccgtggctcagttcagatcgcaggctgcaactcgcctgcgtgaaggaggaatcgctagtaattgcaggtcagcatactgcagtgaattcgttcccgggccttgtacacaccgcccgtcacaccatggaagctggcaacgcccgaagtcattactccaaccattcgtgggggaggatgccgaaggcagtgctggtgactggggtgaagtcgtaacaaggtagccgtaccggaaggtgtggctggatcacctcctttt

SEQ ID NO: 9820 - DNA, 1469 bp, Tranquillimonas sp. M0103
  ref <308>: DATABASE ACCESSION NUMBER: NCBI ACCESSION: NZ_RQXX01000017.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcttaacacatgcaagtcgagcgaagacttcggtcttagcggcggacgggtgagtaacacgtgggaacatgcccttcactgcaggatagtcccgggaaactgggtttaatactgcatacgcccttcgggggaaagatttatcggtgaaggattggcccgcgctggattaggtagttggtggggtaatggcctaccaagccgacgatccatagctggtttgagaggatgatcagccacactgggactgagacacggcccagactcctacgggaggcagcagtggggaatcttagacaatgggcgcaagcctgatctagccatgccgcgtgagtgacgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggattagtcagtcagaggtgaaatcccagggctcaaccctggaactgcctttgatactgctagtcttgagttcgagagaggtgagtggaactccgagtgtagaggtgaaattcgtagatattcggaagaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatggatatcgtagttccgagagatcggttcgtcagttcggctggatatcacacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgggttaatcccaaaaagatgtctcagttcggattggggtctgcaactcgaccccatgaagtcggaatcgctagtaatcgcggaacagcatgccgcggtgaatacgttcccgggccttgtacacaccgcccgtcacaccatgggagttgggtttacccgaaggcggtgcgccaaccttttggaggcagccgaccacggtaagctcagcgactggggtgaagtcgtaacaaggtagccgtaggggaacctgcggctggatcacctcctttctaa

SEQ ID NO: 9821 - DNA, 1564 bp, Treponema pallidum
  ref <308>: DATABASE ACCESSION NUMBER: NCBI ACCESSION: NZ_CP032303.1
  ref <309>: DATABASE ENTRY DATE: 2019-04-01
  ref <313>: RELEVANT RESIDUES IN SEQ ID NO: (1)..(1564)
ggggtttagaataatgatggagagtttgatcctggctcagaacgaacgctggcggtgcgttttaagcatgcaagtcgaacggcaaggaagcgaattttcgtttctctagagtggcggactggtgagtaacgcgtgggtaatctgcctttgagatggggatagcctctagaaatagggggtaataccgaatacgctcttttggacgtaggtctttgagaggaaaggggctgcggcctcgctcagagatgagcctgcgacccattagcttgttggtggggtaatggcctaccaaggcgtcgatgggtatccgacctgagagggtgaccggacacactgggactgagatacggcccagactcctacgggaggcagcagctaagaatattccgcaatgggcgaaagcctgacggagcgacaccgcgtggatgaggaaggtcgaaagattgtaaagttcttttgccgacgaagaatgaggacgggagggaatgcccgtttgatgacggtagtcgtgcgaataagccccggctaattacgtgccagcagccgcggtaacacgtaaggggcgagcgttgttcggaattattgggcgtaaagggcatgcaggcggactggtaagcctggtgtgaaatccccgagctcaacttgggaactgcactgggtactgctggtctagaatcacggaggggaaaccggaattccaagtgtaggggtggaatctgtagatatttggaagaacaccggtggcgaaggcgggtttctggccgatgattgacgctgaggtgcgaaggtgtggggagcgaacaggattagataccctggtagtccacacagtaaacgatgtacactaggtgttggggcatgagtctcggcgccgacgcgaacgcattaagtgtaccgcctggggagtatgctcgcaagagtgaaactcaaaggaattgacgggggcccgcacaagcggtggagcatgtggtttaattcgatgatacgcgaggaaccttacccgggtttgacatcaagaggagcgccgtagaaatgcggtggcgtagcgatacgcctcttgacaggtgctgcatggctgtcgtcagctcgtgccgtgaggtgttgggttaagtcccgcaacgagcgcaacccctactgccagttgccagcaagtggtgttggggactctggcggaactgccggtgacaaaccggaggaaggtggggatgacgtcaagtcatcatggcccttatgtccggggctacacacgtgctacaatggttgctacagagcgatgcgaggttgtgaagtggagcaaaccgcaaaaaggcaatcgtagtccggattgaagtctgaaactcgacttcatgaagttggaatcgctagtaatcgcacatcagcatggtgcggtgaatatgttcccgggccttgtacacaccgcccgtcacaccatccgagttggagatacccgaagtcactagcctaacccgcaagggagggcggtgccgaaggtatgtttggtaaggagggtgaagtcgtaacaaggtagccgtaccggaaggtgcggctggatcacctcctttct

SEQ ID NO: 9822 - DNA, 1567 bp, Trichococcus alkaliphilus
  ref <308>: DATABASE ACCESSION NUMBER: NCBI ACCESSION: NZ_PXZT01000012.1
  ref <309>: DATABASE ENTRY DATE: 2019-04-01
  ref <313>: RELEVANT RESIDUES IN SEQ ID NO: (1)..(1567)
ttacatgagagtttgatcctggctcaggacgaacgctggcggcgtgcctaatacatgcaagtcgaacggtcttttctatggaagcttgcttccactgagaagatagtggcggacgggtgagtaacacgtgggtaacctgcccataagagggggataacatccggaaacgggtgctaataccgcatagtttttctgatcgcatgatcgggaaaggaaagacggcctttgtgctgtcgcttatggatggacccgcggcgtattagttagttggtgaggtaatggctcaccaagacgatgatacgtagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgtcagagaagaacaagtcggagagtaactgctccggccttgacggtatctgaccagaaagccacggctaactacgtgccagcagccgcggtaatacgtaggtggcaagcgttgtccggatttattgggcgtaaagcgagcgcaggcggttccttaagtctgatgtgaaagcccacggctcaaccgtggaaggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccacccttcagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctttgacaatcctagagataggactttcccttcggggacaaagtgacaggtggtgcatggttgtcgtcagctcgtgtcgtgagatgttgggttaagtcccgcaacgagcgcaacccctattgttagttgccagcattcagttgggcactctaatgagactgccggtgacaaaccggaggaaggtggggatgacgtcaaatcatcatgccccttatgacctgggctacacacgtgctacaatggatggtacaacgagcagcaagaccgcgaggtcaagcgaatctcttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaacctttttggagccagccgcctaaggtgggacagatgattggggtgaagtcgtaacaaggtagccgtatcggaaggtgcggctggatcacctcctttctaaggaa

SEQ ID NO: 9823 - DNA, 216 bp, Trichococcus ilyis
  ref <308>: DATABASE ACCESSION NUMBER: NCBI ACCESSION: NZ_FNYT01000027.1
  ref <309>: DATABASE ENTRY DATE: 2019-04-01
  ref <313>: RELEVANT RESIDUES IN SEQ ID NO: (1)..(216)
ttacatgagagtttgatcctggctcaggacgaacgctggcggcgtgcctaatacatgcaagtcgaacggtcttttctatggaagcttgcttccactgagaagatagtggcgaacgggtgagtaacacgtgggtaacctgcccataagagggggataacatccggaaacgggtgctaataccgcataggtttcttagtcgcatgatcgagaaaggaa

SEQ ID NO: 9824 - DNA, 997 bp, Trichococcus paludicola
  ref <308>: DATABASE ACCESSION NUMBER: NCBI ACCESSION: NZ_QBLC01000005.1
  ref <309>: DATABASE ENTRY DATE: 2019-04-01
  ref <313>: RELEVANT RESIDUES IN SEQ ID NO: (1)..(997)
ttacatgagagtttgatcctggctcaggacgaacgctggcggcgtgcctaatacatgcaagtcgaacggtcttttctatggaagcttgcttccactgagaagatagtggcggacgggtgagtaacacgtgggtaacctgcccataagagggggataacatccggaaacgggtgctaataccgcatagttttcttgatcgcatgatcgagaaaggaaagacggcctttgtgctgtcgcttatggatggacccgcggcgtattagttagttggtgaggtaatggctcaccaagacgatgatacgtagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgtcagagaagaacaagttggagagtaactgctccagccttgacggtatctgaccagaaagccacggctaactacgtgccagcagccgcggtaatacgtaggtggcaagcgttgtccggatttattgggcgtaaagcgagcgcaggcggttccttaagtctgatgtgaaagcccacggctcaaccgtggaaggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccacccttcagtgctgcagctaacgcattaagcactccgcctggggagtacggccgcaaggctgaaactcaaaggaattgacggggacccgcacaagcggtggagcatgtggtttaattcgaagcaacgcgaagaacc

SEQ ID NO: 9825 - DNA, 475 bp, Trichococcus pasteurii
  ref <308>: DATABASE ACCESSION NUMBER: NCBI ACCESSION: NZ_FONM01000008.1
  ref <309>: DATABASE ENTRY DATE: 2019-04-01
  ref <313>: RELEVANT RESIDUES IN SEQ ID NO: (1)..(475)
atttacatgagagtttgatcctggctcaggacgaacgctggcggcgtgcctaatacatgcaagtcgaacggtcttttctatggaagcttgcttccactgagaagatagtggcgaacgggtgagtaacacgtgggtaacctgcccataagagggggataacatccggaaacgggtgctaataccgcatagttttcttgatcgcatgatcgagaaaggaaagacggcctttgtgctgtcgcttatggatggacccgcggcgtattagttagttggtgaggtaacggctcaccaagacgatgatacgtagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgtcagagaagaacaagt

SEQ ID NO: 9826 - DNA, 1359 bp, Trichococcus patagoniensis
  ref <308>: DATABASE ACCESSION NUMBER: NCBI ACCESSION: NZ_QAOM01000036.1
  ref <309>: DATABASE ENTRY DATE: 2019-04-01
  ref <313>: RELEVANT RESIDUES IN SEQ ID NO: (1)..(1359)
gaaaggaaagacggcctttgtgctgtcgcttatggatggacccgcggcgtattagttagttggtgaggtaatggctcaccaagacgatgatacgtagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgtcagagaagaacaagtcggagagtaactgctccggccttgacggtatctgaccagaaagccacggctaactacgtgccagcagccgcggtaatacgtaggtggcaagcgttgtccggatttattgggcgtaaagcgagcgcaggcggttccttaagtctgatgtgaaagcccacggctcaaccgtggaaggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccacccttcagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctttgacaatcctagagataggactttcccttcggggacaaagtgacaggtggtgcatggttgtcgtcagctcgtgtcgtgagatgttgggttaagtcccgcaacgagcgcaacccctattgttagttgccagcattcagttgggcactctaatgagactgccggtgacaaaccggaggaaggtggggatgacgtcaaatcatcatgccccttatgacctgggctacacacgtgctacaatggatggtacaacgagcagcaagaccgcgaggtcaagcgaatctcttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaacctttttggagccagccgcctaaggtgggacagatgattggggtgaagtcgtaacaaggtagccgtatcggaaggtgcggctggatcacctcctttctaaggaa

SEQ ID NO: 9827 - DNA, 1567 bp, Trichococcus sp. ART1
  ref <308>: DATABASE ACCESSION NUMBER: NCBI ACCESSION: NZ_UNRR01000003.1
  ref <309>: DATABASE ENTRY DATE: 2019-04-01
  ref <313>: RELEVANT RESIDUES IN SEQ ID NO: (1)..(1567)
ttacatgagagtttgatcctggctcaggacgaacgctggcggcgtgcctaatacatgcaagtcgaacggtcttttctatggaagcttgcttccactgagaagatagtggcggacgggtgagtaacacgtgggtaacctgcccataagagggggataacatccggaaacgggtgctaataccgcatagttttcttgatcgcatgattgagaaaggaaagacggcctttgtgctgtcgcttatggatggacccgcggcgtattagttagttggtgaggtaatggctcaccaagacgatgatacgtagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgtcagagaagaacaagttggagagtaactgctccagccttgacggtatctgaccagaaagccacggctaactacgtgccagcagccgcggtaatacgtaggtggcaagcgttgtccggatttattgggcgtaaagcgagcgcaggcggttccttaagtctgatgtgaaagcccacggctcaaccgtggaaggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccacccttcagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctttgacaatcctagagataggactttcccttcggggacaaagtgacaggtggtgcatggttgtcgtcagctcgtgtcgtgagatgttgggttaagtcccgcaacgagcgcaacccctattgttagttgccagcattcagttgggcactctaatgagactgccggtgacaaaccggaggaaggtggggatgacgtcaaatcatcatgccccttatgacctgggctacacacgtgctacaatggatggtacaacgagcagcaagaccgcgaggtcaagcgaatctcttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaacctttttggagccagccgcctaaggtgggacagatgattggggtgaagtcgtaacaaggtagccgtatcggaaggtgcggctggatcacctcctttctaaggaa

SEQ ID NO: 9828 - DNA, 1287 bp, Trichococcus sp. ES5
  ref <308>: DATABASE ACCESSION NUMBER: NCBI ACCESSION: NZ_FJND01000042.1
  ref <309>: DATABASE ENTRY DATE: 2019-04-01
  ref <313>: RELEVANT RESIDUES IN SEQ ID NO: (1)..(1287)
ggctcaccaagacgatgatacgtagccgacctgagagggtgatcggccacattgggactgagacacggcccaaactcctacgggaggcagcagtagggaatcttccgcaatggacgaaagtctgacggagcaacgccgcgtgagtgaagaaggttttcggatcgtaaaactctgttgtcagagaagaacaagttggagagtaactgctccagccttgacggtatctgaccagaaagccacggctaactacgtgccagcagccgcggtaatacgtaggtggcaagcgttgtccggatttattgggcgtaaagcgagcgcaggcggttccttaagtctgatgtgaaagcccacggctcaaccgtggaaggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccacccttcagtgctgcagctaacgcattaagcactccgcctggggagtacggccgcaaggctgaaactcaaaggaattgacggggacccgcacaagcggtggagcatgtggtttaattcgaagcaacgcgaagaaccttaccaggtcttgacatcctttgacaatcctagagataggactttcccttcggggacaaagtgacaggtggtgcatggttgtcgtcagctcgtgtcgtgagatgttgggttaagtcccgcaacgagcgcaacccctattgttagttgccagcattcagttgggcactctaatgagactgccggtgacaaaccggaggaaggtggggatgacgtcaaatcatcatgccccttatgacctgggctacacacgtgctacaatggatggtacaacgagcagcaagaccgcgaggtcaagcgaatctcttaaagccattctcagttcggattgcaggctgcaactcgcctgcatgaagccggaatcgctagtaatcgcggatcagcacgccgcggtgaatacgttcccgggtcttgtacacaccgcccgtcacaccacgagagtttgtaacacccgaagtcggtgaggtaacctttatggagccagccgcctaaggtgggacagatgattggggtgaagtcgtaacaaggtagccgtatcggaaggtgcggctggatcacctcctttctaaggaa

SEQ ID NO: 9829 - DNA, 1495 bp, Trichodesmium erythraeum
  ref <308>: DATABASE ACCESSION NUMBER: NCBI ACCESSION: NC_008312.1
  ref <309>: DATABASE ENTRY DATE: 2019-04-01
  ref <313>: RELEVANT RESIDUES IN SEQ ID NO: (1)..(1495)
atcatggagagtttgatcctggctcaggatgaacgctggcggtctgcttaacacatgcaagtcgaacggactcttcggagttagtggcggacgggtgagtaacgcgtgagaatctgccttcaggtctgggacaacagaaggaaacttctgctaatcccggatgagccttagggtaaaagataaattgcctggagatgagctcgcgtctgattagctagttggtgtggtaaaagcataccaaggcaacgatcagtagctggtctgagaggatgagcagccacactgggactgagacacggcccagactcctacgggaggcagcagtggggaattttccgcaatgggcgaaagcctgacggagcaagaccgcgtgggggaggaaggctctagggttgtaaaccccttttctttgggaagaagatctgacggtaccaaaggaatcagcctcggctaactccgtgccagcagccgcggtaatacggaggaggcaagcgttatccggaatgattgggcgtaaagcgtccgtagatggccatgtaagtctgctgtcaaaacccagggctcaactctggtcaggcagtggaaactacaaagctagagtttggtaggggcaaagggaattcccggtgtagcggtgaaatgcgtagatatcgggaagaacatcggtggcgaaagcgctttgctagaccaaaactgacattgagggacgaaagctaggggagcgaatgggattagataccccagtagtcctagccgtaaacgatggatactaggtgttgcctgtatcgacccaggcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatgtcgcgaatctaatggaaacatgagagtgccttcgggagcgcgaacacaggtggtgcatggctgtcgtcagctcgtgtcgtgagatgttgggttaagtcccgcaacgagcgcaaccctcgtctttagttgccatcattaagttgggcactctgaagagactgccggtgacaaaccggaggaaggtggggatgacgtcaagtcagcatgccccttacgtcctgggctacacacgtactacaatggttgggacagagggtagcgaacccgagaggggaagccaatccccaaaacccagtctcagttcagattgcaggctgcaactcgcctgcatgaaggaggaatcgctagtaatcgcaggtcagcatactgcggtgaatccgttcccgggccttgtacacaccgcccgtcacaccatggaagttggccacgcccgaagtcattactctaacccgaaagggagggggatgccgaaggtagggctgatgactggggtgaagtcgtaacaaggtagccgtaccggaaggtgtggctggatcacctcctttaaaggga

SEQ ID NO: 9830 - DNA, 1497 bp, Trichormus azollae
  ref <308>: DATABASE ACCESSION NUMBER: NCBI ACCESSION: NC_014248.1
  ref <309>: DATABASE ENTRY DATE: 2019-04-01
  ref <313>: RELEVANT RESIDUES IN SEQ ID NO: (1)..(1497)
aaaacggagagtttgatcctggctcaggatgaacgctggcggtatgcttaacacatgcaagtcgaacgaagttcttaggaacttagtggcggacgggtgagtaacgcgtgagaatttggctttaggtcggggacaaccactggaaacggtggctaataccggatatgccgagaggtgaaagatttattgcctgaagataagctcgcgtctgattagctagttggtggggtaagagcctaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggtcgtaaacctcttttctcagggaagaaaaaaatgacggtacctgaggaataagcatcggctaactccgtgccagcagccgcggtaatacggaggatgcaagcgttatccggaatgattgggcgtaaagggtccgtaggtggtactgtaagtctgctgttaaagagcaaggctcaaccttgtaaaagcagtggaaactacagaactagagtgcgttcggggcagaagggaattcctggtgtagcggtgaaatgcgtagatatcaggaagaacaccggtggcgaaagcgttctgctaggccgcaactgacactgagggacgaaagctaggggagcgaatgggattagataccccagtagtcctagccgtaaacgatggatactaggcgtggcttgtatcgacccgagccgtgccggagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatttcggtgaaagctgagagtgccttcgggagcgcgaacacaggtggtgcatggctgtcgtcagctcgtgtcgtgagatgttgggttaagtcccgcaacgagcgcaaccctcgtttttagttgccagcattaagttgggcactctaaagagactgccggtgacaaaccggaggaaggtgaggatgacgtcaagtcagcatgccccttacgttttgggctacacacgtactacaatgctacggacaaagggcagcaagctagcaatagcaagcaaatctcataaaccgtagctcagttcagatcgaaggctgcaactcgccttcgtgaaggaggaatcgctagtaattgcaggtcagcatactgcagtgaattcgttcccgggccttgtacacaccgcccgtcacaccatggaagttggtcacgcccgaagtcattaccccaaccttttggagggggatgcctaaggtaggactggtgactggggtgaagtcgtaacaaggtagccgtaccggaaggtgtggctggatcacctcctttttaggga

SEQ ID NO: 9831 - DNA, 1492 bp, Trichormus sp. NMC-1
  ref <308>: DATABASE ACCESSION NUMBER: NCBI ACCESSION: NZ_LZQD01000003.1
  ref <309>: DATABASE ENTRY DATE: 2019-04-01
  ref <313>: RELEVANT RESIDUES IN SEQ ID NO: (1)..(1492)
aaaacggagagtttgatcctggctcaggatgaacgctggcggtatgcttaacacatgcaagtcgaacggaatccttagggatttagtggcggacgggtgagtaacgcgtgagaatctggcttcaggtctgggacaacagttggaaacgactgctaataccggatgtgccgagaggtgaaaggcttgctgcctgaagatgagcttgcgtctgattagctagttggtggggtaagagcctaccaaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaaaaaaatgacggtacctgaggaataagcatcggctaactccgtgccagcagccgcggtaatacggaggatgcaagcgttatccggaatgattgggcgtaaagggtccgcaggtggctgtgtaagtctgctgttaaagagtcatgctcaacatgataagggcagtggaaactacacagctagagtgcgttcggggcagagggaattcctggtgtagcggtgaaatgcgtagatatcaggaagaacaccggtggcgaaagcgctctgctaggccgcaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatttccttgaaaggggaaagtgccttcgggagcgcgaacacaggtggtgcatggctgtcgtcagctcgtgtcgtgagatgttgggttaagtcccgcaacgagcgcaaccctcgtttctagttgccagcaataagatgggaactctagagagactgccggtgacaaaccggaggaaggtggggatgacgtcaagtcagcatgccccttacgtcttgggctacacacgtactacaatgctacggacaaagggcagctacacagcgatgtgatgcaaatctcataaaccgtagctcagttcagatcgaaggctgcaactcgccttcgtgaaggaggaatcgctagtaattgcaggtcagcatactgcagtgaattcgttcccgggccttgtacacaccgcccgtcacaccatggaagtcggtcacgcccgaagtcattaccccaaccttttggagggggatgcctaaggtaggactggtgactggggtgaagtcgtaacaaggtagccgtaccggaaggtgtggctggatcacctccttttta

SEQ ID NO: 9832 - DNA, 772 bp, Trichormus variabilis
  ref <308>: DATABASE ACCESSION NUMBER: NCBI ACCESSION: NZ_RSCM01000049.1
  ref <309>: DATABASE ENTRY DATE: 2019-04-01
  ref <313>: RELEVANT RESIDUES IN SEQ ID NO: (1)..(772)
cggtggcgaaagcgctctgctaggccgcaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaagacttgacatgtcgcgaatcttcttgaaaggggagagtgccttcgggagcgcgaacacaggtggtgcatggctgtcgtcagctcgtgtcgtgagatgttgggttaagtcccgcaacgagcgcaaccctcgtttctagttgccagcaataagatgggaactctagagagactgccggtgacaaaccggaggaaggtggggatgacgtcaagtcagcatgccccttacgtcttgggctacacacgtactacaatgctacggacaaagggcagctacacagcgatgtgatgcaaatctcataaaccgtagctcagttcagatcgaaggctgcaactcgccttcgtgaaggaggaatcgctagtaattgcaggtcagcatactgcaggaattcgttcccgggccttgtacacaccgcccgtcacacccatggaagtcggtcacgcccgaagtcattaccccaacctttggagggggatgcctaaggtaggactggtgactggggtga

SEQ ID NO: 9833 - DNA, 1465 bp, Tritonibacter horizontis
  ref <308>: DATABASE ACCESSION NUMBER: NCBI ACCESSION: NZ_LPUY01000004.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcttaacacatgcaagtcgagcgctctcttcggagggagcggcggacgggttagtaacgcgtgggaacgtgcccttctctaaggaatagccactggaaacggtgagtaataccttatacgcccttcgggggaaagatttatcggagaaggatcggcccgcgttagattagatagttggtggggtaacggcctaccaagtctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgcctgtgaagataatgactgtagcaggtaaagaaaccccggctaactccgtgccagcagccgcggtaatacggagggggttagcgttgttcggaattactgggcgtaaagcgcacgtaggcggatcagaaagttgggggtgaaatcccagggctcaaccctggaactgcctccaaaactcctggtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgccagagagatttggctttcacttcggtgaccgagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaaggccgtgcgctaacttttgaggcagcggaccacggtgagctcagcgactggggtgaagtcgtaacaaggtagccgtaggggaacctgcggctggatcacctcctttctaa

SEQ ID NO: 9834 - DNA, 1467 bp, Tropicibacter phthalicicus
  ref <308>: DATABASE ACCESSION NUMBER: NCBI ACCESSION: NZ_FXXP01000001.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcgaccttcgggttgagcggcggacgggttagtaacgcgtgggagcgtacccagatctaaggaatagccactggaaacggtgagtaataccttatacgcccttcgggggaaagatttatcggatttggatcggaccgcgttagattaggtagttggtgcggtaacggcgcaccaagcctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagagatgataatgacagtatctggtaaagaaaccccggctaactccgtgccagcagccgcggtaatacggagggggttagcgttgttcggaattactgggcgtaaagcgcgcgtaggcggaccagaaagttaggggtgaaatcccggggctcaaccccggaactgcctctaaaactcctgatctagagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagtatactattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgtgctacatccagagatggatggttcccttcggggacgcagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcagtgacaatgggttaatccccaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacgacgctgcgctaaccttcgggaggcaggcggccacggtaggatcagcgactggggtgaagtcgtaacaaggtagccgtaggggaacctgcggctggatcacctcctttctaa

SEQ ID NO: 9835 - DNA, 1465 bp, Tropicibacter sp. LMIT003
  ref <308>: DATABASE ACCESSION NUMBER: NCBI ACCESSION: NZ_RCTZ02000042.1
  ref <309>: DATABASE ENTRY DATE: 2019-04-01
  ref <313>: RELEVANT RESIDUES IN SEQ ID NO: (1)..(1465)
tcaacttgagagtttgatcctggctcagaacgaacgctggcggcaggcctaacacatgcaagtcgagcgcaccttcgggtgagcggcggacgggttagtaacgcgtgggaacgtacccagatctaaggaatagccactggaaacggtgagtaataccttatacgcccttcgggggaaagatttatcggatttggatcggcccgcgttagattaggtagttggtggggtaatggcctaccaagcctacgatctatagctggttttagaggatgatcagcaacactgggactgagacacggcccagactcctacgggaggcagcagtggggaatcttggacaatgggcgcaagcctgatccagccatgccgcgtgagtgatgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattggaaagttgggggtgaaatcccagggctcaaccctggaactgcctccaaaactcccagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggcagtatactgttcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcccgcgctacatcgagagatcgatggttcccttcggggacgcggtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggtatctacagtgggttaatccccaaaagatatctcagttcggattggggtctgcaactcgaccccatgaagtcggaatcgctagtaatcgcgtaacagcatgacgcggtgaatacgttcccgggccttgtacacaccgcccgtcacaccatgggagttggttctacctgacggccgtgcgctaaccttcgggaggcagcggaccacggtaggatcagcgactggggtgaagtcgtaacaaggtagccgtaggggaacctgcggctggatcacctcctttctaa

SEQ ID NO: 9836 - DNA, 1473 bp, Tropicimonas sediminicola
  ref <308>: DATABASE ACCESSION NUMBER: NCBI ACCESSION: NZ_FZOY01000024.1
  ref <309>: DATABASE ENTRY DATE: 2019-04-01
  ref <313>: RELEVANT RESIDUES IN SEQ ID NO: (1)..(1473)
caacttgagagtttgatcctggctcagaacgaacgctggcggcaggcctaacacatgcaagtcggacgagaccttcgggtctagtggcgaacgggttagtaacgcgtgggaacgtgcctctctctacggaatagtcccgggaaactgggtttaataccgtatacgccctttggggggaaagatttatcggagagagatcggcccgcgttggattaggtagttggtggggtaatggcctaccaagccgacgatccatagctggtttgagaggatgatcagcaacactgggactgagacacggcccagactcctacgggaggcagcagtggggaatcttagacaatgggggcaaccctgatctagccatgccgcgtgagtgatgaaggccctagggtcgtaaagctctttcgcctgtgaagataatgacggtagcaggtaaagaaaccccggctaactccgtgccagcagccgcggtaatacggagggggttagcgttgttcggaattactgggcgtaaagcgcgcgtaggcggactattaagtcaggggtgaaatcccggggctcaaccccggaactgcccttgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagtcgtcgggtagcatgctgctcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatctggatcgcggttaccggagacggtttccttcagttcggctggatccaagacaggtgctgcatggctgtcgtcagctcgtgtcgtgagatgttcggttaagtccggcaacgagcgcaacccacgtccttagttgccagcagttcggctgggcactctaaggaaactgccgatgataagtcggaggaaggtgtggatgacgtcaagtcctcatggcccttacgggttgggctacacacgtgctacaatggtagtgacaatgggttaatcccaaaaagctatctcagttcggattgtcgtctgcaactcgacggcatgaagtcggaatcgctagtaatcgcgtaacagcatgacgcggtgaatacgttcccgggccttgtacacaccgcccgtcacaccatgggagttgggtctacccgaagacggtgcgccaacctgtaaagggggcagctggccacggtaggctcagcgactggggtgaagtcgtaacaaggtagccgtaggggaacctgcggctggatcacctcctttctaa

SEQ ID NO: 9837 - DNA, 1471 bp, Tropicimonas sp. IMCC34011
  ref <308>: DATABASE ACCESSION NUMBER: NCBI ACCESSION: NZ_QMEJ01000009.1
  ref <309>: DATABASE ENTRY DATE: 2019-04-01
  ref <313>: RELEVANT RESIDUES IN SEQ ID NO: (1)..(1471)
caacttgagagtttgatcctggctcagaacgaacgctggcggcaggcttaacacatgcaagtcgagcgaggtcttcggacctagcggcggacgggtgagtaacgcgtgggaacgtgcccttcactgcggaatagtcccgggaaactgggtttaataccgcatacgcccttcgggggaaagatttatcggtgaaggatcggcccgcgttggattagatagttggtggggtaatggcctaccaagtcgacgatccatagctggtttgagaggatgatcagccacactgggactgagacacggcccagactcctacgggaggcagcagtggggaatcttagacaatgggcgcaagcctgatctagccatgccgcgtgagtgacgaaggccctagggtcgtaaagctctttcgccagggaagataatgacggtacctggtaaagaaaccccggctaactccgtgccagcagccgcggtaatacggagggggttagcgttgttcggaattactgggcgtaaagcgcgcgtaggcggactgttaagtcgggggtgaaatcccggggctcaaccccggaactgccctcgatactggcagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatctggatcgcggttttccgagaggaattccttcagttcggctggatccaagacaggtgctgcatggctgtcgtcagctcgtgtcgtgagatgttcggttaagtccggcaacgagcgcaacccacatccctagttgccagcagttcggctgggcactctatggaaactgcccgtgataagcgggaggaaggtgtggatgacgtcaagtcctcatggcccttacgggttgggctacacacgtgctacaatggtagtgacaatgggttaatccccaaaagctatctcagttcggattggggtctgcaactcgaccccatgaagtcggaatcgctagtaatcgcgtaacagcatgacgcggtgaatacgttcccgggccttgtacacaccgcccgtcacaccatgggagttgggtttacccgaagacggtgcgccgacccttacggggggcagccggccacggtaagctcagcgactggggtgaagtcgtaacaaggtagccgtaggggaacctgcggctggatcacctcctttcta

SEQ ID NO: 9838 - DNA, 1472 bp, Tropicimonas sp. IMCC34043
  ref <308>: DATABASE ACCESSION NUMBER: NCBI ACCESSION: NZ_QMEK01000011.1
  ref <309>: DATABASE ENTRY DATE: 2019-04-01
  ref <313>: RELEVANT RESIDUES IN SEQ ID NO: (1)..(1472)
caacttgagagtttgatcctggctcagaacgaacgctggcggcaggcttaacacatgcaagtcgagcgagatcttcggatctagcggcggacgggtgagtaacgcgtgggaacgtgccctttgctacggaatagccctgggaaactgggagtaataccgtatgtgcccttcgggggaaagatttatcggcaaaggatcggcccgcgttggattaggtagttggtggggtaatggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccctagggtcgtaaagctctttcgccagggaagataatgacggtacctggtaaagaagtcccggctaactccgtgccagcagccgcggtaatacggaggggactagcgttgttcggaattactgggcgtaaagcgcgcgtaggcggactattaagtcaggggtgaaatcccggggctcaaccccggaactgcctctgatactggtagtcttgagttcgagagaggtgagtggaattccgagtgtagaggtgaaattcgtagatattcggaggaacaccagtggcgaaggcggctcactggctcgatactgacgctgaggtgcgaaagtgtggggagcaaacaggattagataccctggtagtccacaccgtaaacgatgaatgccagacgtcgggcagcatgctgttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatctggatcgcggttacccgagagggtttccttcagttcggctggatccgagacaggtgctgcatggctgtcgtcagctcgtgtcgtgagatgttcggttaagtccggcaacgagcgcaacccacgtccttagttgccagcagttcggctgggcactctaaggaaactgccggtgataagccggaggaaggtgtggatgacgtcaagtcctcatggcccttacgggttgggctacacacgtgctacaatggcagtgacaatgggttaatcccaaaaagctgtctcagttcggattgtcgtctgcaactcgacggcatgaagtcggaatcgctagtaatcgcgtaacagcatgacgcggtgaatacgttcccgggccttgtacacaccgcccgtcacaccatgggagttgggtctacccgaagacggtgcgccaacctttacagggggcagctggccacggtaggctcagcgactggggtgaagtcgtaacaaggtagccgtaggggaacctgcggctggatcacctcctttctaa

SEQ ID NO: 9839 - DNA, 1047 bp, Tropicimonas sp. IMCC6043
  ref <308>: DATABASE ACCESSION NUMBER: NCBI ACCESSION: NZ_SELO01000116.1
  ref <309>: DATABASE ENTRY DATE: 2019-04-01
  ref <313>: RELEVANT RESIDUES IN SEQ ID NO: (1)..(1047)
caacttgagagtttgatcctggctcagaacgaacgctggcggcaggcctaacacatgcaagtcgagcgagaccttcgggtctagcggcggacgggttagtaacgcgtgggaacgtgcccttctctacggaatagtcccgggaaactgggtttaataccgtatacgccctttgggggaaagatttatcggagaaggatcggcccgcgttggattaggtagttggtggggtaacggcctaccaagccgacgatccatagctggtttgagaggatgatcagcaacactgggactgagacacggcccagactcctacgggaggcagcagtggggaatcttagacaatgggggcaaccctgatctagccatgccgcgtgagtgatgaaggccctagggtcgtaaagctctttcgcctgtgaagataatgacggtagcaggtaaagaagtcccggctaactccgtgccagcagccgcggtaatacggaggggactagcgttgttcggaattactgggcgtaaagcgcgcgtaggcggactattaagtcaggggtgaaatcccggggctcaaccccggaactgcctttgatactggtagtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagacgtcggcaggcatgcctgtcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatctggatcgcggttttccgagaggaattccttcagttcggctggatccaagacaggtgctgcatggctgtcgtcagctcgtgtcgtgagatgttcggttaagtccggca

SEQ ID NO: 9840 - DNA, 1537 bp, Trueperella bialowiezensis
  ref <308>: DATABASE ACCESSION NUMBER: NCBI ACCESSION: NZ_LR134476.1
  ref <309>: DATABASE ENTRY DATE: 2019-04-01
  ref <313>: RELEVANT RESIDUES IN SEQ ID NO: (1)..(1537)
tttgtggagagtttgatcctggctcaggacgaacgctggcggcgtgcttaacacatgcaagtcgaacgatgatgcttggcgcttgcgctgggtggattagtggcgaacgggtgagtaatacgtgagtaacctgccctcttctttgggataagcttgggaaactgggtctaatactggatattctgctcttgccgcatggtgggggttggaaagggtttttctggtgggggatgggctcacggcctatcagcttgttggtggggtgatggcctaccaaggcgtcgacgggtagccggcctgagagggtgaccggccacattgggactgagatacggcccagactcctacgggaggcagcagtggggaatattgcacaatggacggaagtctgatgcagcgacgccgcgtgggggatgaaggctttcgggttgtaaactcctttcagtacagaagaagctttttgtgacggtatgtgcagaagaagcaccggctaactacgtgccagcagccgcggtaatacgtagggtgcgagcgttgtccggaattattgggcgtaaagggcttgtaggcggtttgttgcgcctgctgtgaaattctggggcttaactttgggattgcagtgggtacgggcagactagagtgtggtaggggtaattggaattcctggtgtagcggtggaatgcgcagatatcaggaggaacaccgatggcgaaggcaggttactgggccaccactgacgctgaggagcgaaagcgtgggtagcgaacaggattagataccctggtagtccatgctgtaaacgttgggcactaggtgtggggccttttccatgggttctgcgccgtagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcactgggatctctcagagatgggggagtctttggactggtgtacaggtggtgcatggttgtcgtcagctcgtgtcgtgagatgttgggttaagtcccgcaacgagcgcaacccttgtcttgtgttgccagcaatttttggttggggactcacgagagactgccggggttaactcggaggaaggtggggatgacgtcaaatcatcatgccccttatgtcttgggcttcacgcatgctacaatggcaggtacagtgtgttgcgatcccgtgagggtgggctaatcacttaaagcttgtctcagttcggattggggtctgcaactcgacctcatgaagtcggagtcgctagtaatcgcagatcagctacgctgcggtgaatacgttctcgggccttgtacacaccgcccgtcacgtcacgaaagttggtgacacccgaagcccgtggcctaacacgtttgtgggggagcggtcgaaggtgggactggcgattgggacgaagtcgtaacaaggtagccgtaccggaaggtgcggctggatcacctcctttctaggga

SEQ ID NO: 9841 - DNA, 1526 bp, Tsukamurella paurometabola
  ref <308>: DATABASE ACCESSION NUMBER: NCBI ACCESSION: NZ_LR131273.1
  ref <309>: DATABASE ENTRY DATE: 2019-04-01
  ref <313>: RELEVANT RESIDUES IN SEQ ID NO: (1)..(1526)
ttttatggagagtttgatcctggctcaggacgaacgctggcggcgtgcttaacacatgcaagtcgaacggtaaggccctttcgggggtacacgagtggcgaacgggtgagtaacacgtgggtgacctgccctgtacttcgggataagcctgggaaactgggtctaataccggatatgaccttctcctgcatgggggttggtggaaagcttttgcggtacaggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggacgaagcgcaagtgacggtacctacagaagaagcaccggccaactacgtgccagcagccgcggtaatacgtagggtgcgagcgttgtccggatttactgggcgtaaagagctcgtaggcggtttgtcgcgtcgtctgtgaaaacccgaggcttaacctcgggcctgcaggcgatacgggcagacttgagtactgtaggggagactggaattcctggtgtagcggtggaatgcgcagatatcaggaggaacaccggtggcgaaggcgggtctctgggcagtaactgacgctgaggagcgaaagcgtgggtagcgaacaggattagataccctggtagtccacgccgtaaacggtgggtactaggtgtgggtttccttccacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatatagaggatcgccgcagagatgtggtttgccttgtgccttctatacaggtggtgcatggctgtcgtcagctcgtgtcgtgagatgttgggttaagtcccgcaacgagcgcaacccttgtctcatgttgccagcacgttatggtggggactcgtgagagactgccggggtcaactcggaggaaggtggggatgacgtcaagtcatcatgccccttatgtccagggcttcacacatgctacaatggcgcgtacagagggctgcgataccgtgaggtggagcgaatcccttaaagcgcgtctcagttcggattggggtctgcaactcgaccccatgaagtcggagtcgctagtaatcgcagatcagcaacgctgcggtgaatacgttcccgggccttgtacacaccgcccgtcacgtcatgaaagtcggtaacacccgaagccggtggcctaaccccttgtgggagggagctgtcgaaggtgggattggcgattgggacgaagtcgtaacaaggtagccgtaccggaaggtgcggctggatcacctcctttctaa

SEQ ID NO: 9842 - DNA, 249 bp, Tuberibacillus calidus
  ref <308>: DATABASE ACCESSION NUMBER: NCBI ACCESSION: NZ_AUMM01000027.1
  ref <309>: DATABASE ENTRY DATE: 2019-04-01
  ref <313>: RELEVANT RESIDUES IN SEQ ID NO: (1)..(249)
tttacggagagtttgatcctggctcaggacgaacgctggcggcgtgcctaatacatgcaagtcgagcgcgtgaaattcgtggatctcttcggagtgatgcggatggatcgagcggcggacgggtgagtaacacgtgggcaacctgcccgtaagactgggataacttcgggaaaccgaagctaataccggataggctttcgcaccgcatggtgcgaaagggaaaggtgcttctggcatcacttacggatg

SEQ ID NO: 9843 - DNA, 1552 bp, Tuberibacillus sp. Marseille-P3662
  ref <308>: DATABASE ACCESSION NUMBER: NCBI ACCESSION: NZ_FXBS01000005.1
  ref <309>: DATABASE ENTRY DATE: 2019-04-01
  ref <313>: RELEVANT RESIDUES IN SEQ ID NO: (1)..(1552)
tttatggagagtttgatcctggctcaggacgaacgctggcggcgtgcctaatacatgcaagtcgagcgcgagatattctatgatttcttcggagtgattaggatggatcgagcggcggacgggtgagtaacacgtgggtaacctgcctgtaagctcggaataaccccgggaaaccggagctaatgccgaatgtgatcatcgcaccgcatggtgcgatgaataaagacggctttgtcgtcacttacagaggggcccgcggcgcattagcttgttggtgaggttaaagcttaccaaggcgacgatgcgtagccgacctgagagggtgatcggccacactgggactgagacacggcccagactcctacgggaggcagcagtagggaatcatccgcaatggacgaaagtctgacggtgcaacgccgcgtgagtgatgaaggtcttcggatcgtaaagctctgttgtcagcgaagaacaggtgccataggtaatgatggcgctttgacggtatctgaccagaaagccccggctaactacgtgccagcagccgcggtaatacgtagggggcaagcgttgtccggaattattgggcgtaaagcgcgcgcaggcggcttcttaagtctgatgtgaaagcccgtggctcaaccacggaggggcattggaaactggggggcttgagtacaggagaggagagcggaattccacgtgtagcggtgaaatgcgtagagatgtggaggaacaccagtggcgaaagcggctctctggcctgtaactgacgctgaggcgcgaaagcgtggggagcgaacaggattagataccctggtagtccacgccgtaaacgatgagtgctaggtgttaggggggtccaaccccttagtgctgaagttaacacattaagcactccgcctggggagtacgaccgcaaggttgaaactcaaaggaattgacgggggcccgcacaagcagtggagcatgtggtttaattcgaagcaacgcgaagaaccttaccaggtcttgacatcctctgacaaccctagagatagggcgttccccttcgggggacagagtgacaggtggtgcatggttgtcgtcagctcgtgtcgtgagatgttgggttaagtcccgcaacgagcgcaacccctaatcttagttgccagcattcagttgggcactctaaggtgactgccggtgacaaaccggaggaaggtggggatgacgtcaaatcatcatgccccttatgacctgggcaacacacgtgctacaatgggcggcacaacgggcagcgaaaccgcgaggttcagcgaatcccttaaagccgctctcagttcggattgtaggctgcaactcgcctgcatgaagccggaattgctagtaatcgcggatcagcatgccgcggtgaatccgttcccgggccttgtacacaccgcccgtcacaccacgagagtccgcaacacccgaagtcggctccggccgccgaaggtggggcgaatgattggggtgaagtcgtaacaaggtagccgtatcggaaggtgcggctggatcacctcctttctaa

SEQ ID NO: 9844 - DNA, 911 bp, Tumebacillus flagellatus
  ref <308>: DATABASE ACCESSION NUMBER: NCBI ACCESSION: NZ_JMIR01000093.1
  ref <309>: DATABASE ENTRY DATE: 2019-04-01
  ref <313>: RELEVANT RESIDUES IN SEQ ID NO: (1)..(911)
ttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccac

SEQ ID NO: 9845 - DNA, 1525 bp, Turicibacter sanguinis
  ref <308>: DATABASE ACCESSION NUMBER: NCBI ACCESSION: NZ_RCYV01000045.1
  ref <309>: DATABASE ENTRY DATE: 2019-04-01
  ref <313>: RELEVANT RESIDUES IN SEQ ID NO: (1)..(1525)
attatggagagtttgatcctggctcaggatgaacgctggcggcgtgcctaatacatgcaagtcgagcgaaccacttcggtggtgagcggcgaacgggtgagtaacacgtaggttatctgcccatcagacggggacaacgattggaaacgatcgctaataccggataggacgaaagtttaaaggtgcttcggcaccactgatggatgagcctgcggcgcattagctagttggtagggtaaaggcctaccaaggcgacgatgcgtagccgacctgagagggtgaacggccacactgggactgagacacggcccagactcctacgggaggcagcagtagggaatcttcggcaatgggcgaaagcctgaccgagcaacgccgcgtgaatgatgaaggccttcgggttgtaaaattctgttataagggaagaatggctctagtaggaaatggctagagtgtgacggtaccttatgagaaagccacggctaactacgtgccagcagccgcggtaatacgtaggtggcgagcgttatccggaattattgggcgtaaagagcgcgcaggtggttgattaagtctgatgtgaaagcccacggcttaaccgtggagggtcattggaaactggtcaacttgagtgcagaagagggaagtggaattccatgtgtagcggtgaaatgcgtagagatatggaggaacaccagtggcgaaggcggcttcctggtctgtaactgacactgaggcgcgaaagcgtggggagcaaacaggattagataccctggtagtccacgccgtaaacgatgagtgctaagtgttgggggtcgaacctcagtgctgaagttaacgcattaagcactccgcctggggagtacggtcgcaagactgaaactcaaaggaattgacggggacccgcacaagcggtggagcatgtggtttaattcgaagcaacgcgaagaaccttaccaggtcttgacataccagtgaccgtcctagagataggattttcccttcggggacaatggatacaggtggtgcatggttgtcgtcagctcgtgtcgtgagatgttgggttaagtcccgcaacgagcgcaacccctgtcgttagttgccagcattcagttggggactctaacgagactgccagtgacaaactggaggaaggtggggatgacgtcaaatcatcatgccccttatgacctgggctacacacgtgctacaatggttggtacaaagagaagcgaagcggtgacgtggagcaaacctcataaagccaatctcagttcggattgtaggctgcaactcgcctacatgaagttggaatcgctagtaatcgcgaatcagcatgtcgcggtgaatacgttcccgggtcttgtacacaccgcccgtcacaccacgagagtttacaacacccgaagtcagtggcctaaccgcaaggagggagctgcctaaggtggggtagatgattggggtgaagtcgtaacaaggtatccctaccggaaggtggggatggatcacctcctttctatggaga

SEQ ID NO: 9846 - DNA, 1518 bp, Turneriella parva
  ref <308>: DATABASE ACCESSION NUMBER: NCBI ACCESSION: NC_018020.1
  ref <309>: DATABASE ENTRY DATE: 2019-04-01
  ref <313>: RELEVANT RESIDUES IN SEQ ID NO: (1)..(1518)
atggagagtttgattctggctcagaacgaacgctggcggcgcgtcttaaacatgcaagtcgaacgatctgtagcaatacagggagtggcggacgggtgaggaacacgtaggaatctacctcgaagagcgggacaactttgggaaaccggggctaataccgcatagtacagagatgttaaagggctagcaatagtcgcttcgagatgagcctgcggtctatcagcttgttggtgaggtaatggctcaccaaggctacgacggatagccggtctgagaggatgatcggccacactggcactgagacacgggccagactcctacgggaggcagcagttaagaatcttgcgcaatgggggcaaccctgacgcagcgacgccgcgtgaaggatgaaggctttcgggttgtaaacttcggtagactgggaagaagaactacgttcgttgagggcgtagagtgacggtaccagtctgaagccccggctaattacgtgccagcagccgcggtaatacgtatggggcaagcgttgttcggaattattgggcgtaaagggctcgcaggtggtttgttaagttggtggtttaatctctgggctcaacccagagtcagcctccaaaactggcgaacttgagtacgataggggatagcggaattctcggtgtagcggtggaatgcgtagatatcgagaggaacaccaatggcgaaggcagctatctggatcgtaactgacactcatgagcgaaagtgcggggagcaaacaggattagataccctggtagtccgcaccgtaaacgttgtatactagttgttggtggtttcaacgccatcagtgacgtcgctaacgcattaagtataccgcctggggagtatgctcgcaagggtgaaactcaaagaaattgacgggggcccgcacaagcggtggagcatgtggtttaattcgacgatacgcgagaaaccttacctgggtttgacatggatttgactggggtagagataccccttcccgcaagggcagattcacaggtgttgcatggtcgtcgtcagctcgtgttgtgagatgttgggttaagtcccgcaacgagcgcaacccctatcttctgttgccatcattaagttgggcactctgaagaaaccgccggtgacaaaccggaggaaggtggggatgacgtcagatcagcatggcccttatatccagggctacacacgtgctacaatggccggtacagagggacgcaatgccgcgaggtggagcaaatcccacaaagccggtctcagttcagattgcagtctgcaactcgactgcatgaagtcggaatcgctagtaatcgcaaatcagcatgttgcggtgaatacgttcccgggccttgtacacaccgcccgtcacaccacccgagttggaggtacccgaagaggctgttgccaaccgcaaggaggcaggtcgctaaggtaaattcggcgaggggggtgaagtcgtaacaaggtagccgtaccggaaggtgcggctggatcacctccttaaaa

SEQ ID NO: 9847 - DNA, 1536 bp, Umboniibacter marinipuniceus
  ref <308>: DATABASE ACCESSION NUMBER: NCBI ACCESSION: NZ_REFJ01000011.1
  ref <309>: DATABASE ENTRY DATE: 2019-04-01
  ref <313>: RELEVANT RESIDUES IN SEQ ID NO: (1)..(1536)
taaactgaagagtttgatcatggctcagattgaacgctggcggcaggcctaacacatgcaagtcgaacgcgaaatcacttcggtgagagtagagtggcggacgggtgagtaacgcgtgggaatctacctcgtagtgggggacaacttgtggaaacgcaagctaataccgcatacgtcctaagggagaaagcaggggatcttcggaccttgtgctatgagatgagcccgcgtcggattagctagttggtggggtaaaggcctaccaaggcgacgatccgtagctggtctgagaggatgatcagccacactggaactgagacacggtccagactcctacgggaggcagcagtggggaatattgcacaatgggcgaaagcctgatgcagccatgccgcgtgtgtgaagaaggctctagggttgtaaagcactttcagcaaggaggaaaggttgtcagttaatacctggcagctgtgacgttacttgcagaagaagcaccggctaactccgtgccagcagccgcggtaatacggagggtgcaagcgttaatcggaattactgggcgtaaagcgcgcgtaggcggtctgttaagctggatgtgaaagcccagggctcaaccttggaactgcattcagaactggcagactagagtattggagaggtgagtggaatttcccgtgtagcagtgaaatgcgtagatatgggaaggaacaccagtggcgaaggcgactcactggccaaatactgacgctgaggtgcgaaagcgtggggagcaaacgggattagataccccggtagtccacgccgtaaacgatgtctactagccgttgggatccttgagattttagtggcgcagctaacgcactaagtagaccgcctggggagtacggccgcaaggttaaaactcaaatgaattgacgggggcccgcacaagcggtggagcatgtggtttaattcgaagcaacgcgaagaaccttaccaggtcttgacatccagagaacttactagagatagtttggtgccttcgggaactctgagacaggtgctgcatggctgtcgtcagctcgtgtcgtgagatgttgggttaagtcccgcaacgagcgcaacccttgtcctatgttgccagcacataatggtgggaactcatgggagactgccggtgataaaccggaggaaggtggggacgacgtcaagtcatcatggcccttacgacctgggctacacacgtgctacaatggtgcatacaaacggttgccaagccgcgaggtggagctaatctgagaaagtgcatcgtagtccggattggagtctgcaactcgactccatgaagtcggaatcgctagtaatcgtgaatcagaatgtcacggtgaatacgttcccgggccttgtacacaccgcccgtcacaccatgggagtgggttgctccagaagtggctagtctaaccttcggggggacggtcaccacggagtgattcatgactggggtgaagtcgtaacaaggtaaccctaggggaacctggggttggatcacctccttaa

SEQ ID NO: 9848 - DNA, 1542 bp, Undibacterium parvum
  ref <308>: DATABASE ACCESSION NUMBER: NCBI ACCESSION: NZ_CP034464.1
  ref <309>: DATABASE ENTRY DATE: 2019-04-01
  ref <313>: RELEVANT RESIDUES IN SEQ ID NO: (1)..(1542)
agattaaactgaagagtttgatcctggctcagattgaacgctggcggcatgccttacacatgcaagtcgaacggtaacgcggagcaatctggcgacgagtggcgaacgggtgagtaatatatcggaacataccctagagtgggggataacgtagcgaaagttacgctaataccgcatacgatctgaggatgaaagtgggggatcgcaagacctcatgctcatggagtggccgatatctgattagctagttggtagggtaaaagcctaccaaggcgacgatcagtagctggtttgagagaacgaccagccacactggaactgagacacggtccagactcctacgggaggcagcagtggggaattttggacaatgggggcaaccctgatccagcaatgccgcgtgagtgaagaaggccttcgggttgtaaagctcttttgtcagggaagaaaaggtagtctctaatacagactgctcatgacggtacctgaagaataagcaccggctaactacgtgccagcagccgcggtaatacgtagggtgcaagcgttaatcggaattactgggcgtaaagcgtgcgcaggcggttatataagtcagatgtgaaatccctgggctcaacctaggaactgcatttgagactgtatggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgttgggtcttaattgacttagtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacagaatgccgaagagatttggcggtgctcgcaagagaactgtaacacaggtgctgcatggctgtcgtcagctcgtgtcgtgagatgttgggttaagtcccgcaacgagcgcaacccttgtcattagttgctacattaagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggtttcgccagaagtaggtagcttaaccgtaaggagggcgcttaccacggcgggattcgtgactggggtgaagtcgtaacaaggtagccgtatcggaaggtgcggctggatcacctcctttctag

SEQ ID NO: 9849 - DNA, 1542 bp, Undibacterium sp. S11R28
  ref <308>: DATABASE ACCESSION NUMBER: NCBI ACCESSION: NZ_RXKK01000003.1
  ref <309>: DATABASE ENTRY DATE: 2019-04-01
  ref <313>: RELEVANT RESIDUES IN SEQ ID NO: (1)..(1542)
agattaaactgaagagtttgatcctggctcagattgaacgctggcggcatgccttacacatgcaagtcgaacggtaacaggtcttcggatgctgacgagtggcgaacgggtgagtaatatatcggaacataccctagagtgggggataacgtagcgaaagttacgctaataccgcatacgatctgaggatgaaagtgggggctcgcaagacctcatgctcatggagtggccgatatctgattagctagttggtgaggtaaaggctcaccaaggcgacgatcagtagctggtttgagagaacgaccagccacactggaactgagacacggtccagactcctacgggaggcagcagtggggaattttggacaatgggggcaaccctgatccagcaatgccgcgtgagtgaagaaggccttcgggttgtaaagctcttttgtcagggaagaaaaggtatcctctaatacagggtgctcatgacggtacctgaagaataagcaccggctaactacgtgccagcagccgcggtaatacgtagggtgcaagcgttaatcggaattactgggcgtaaagcgtgcgcaggcggttatgtaagtcagatgtgaaatccccgggctcaacctgggaactgcatttgagactgcatggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgttgggtcttaattgacttagtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatgtacagaatgccgaagagatttggcggtgctcgcaagagaactgtaacacaggtgctgcatggctgtcgtcagctcgtgtcgtgagatgttgggttaagtcccgcaacgagcgcaacccttgtcattagttgctacattaagttgagcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattgtagtctgcaactcgactacatgaagttggaatcgctagtaatcgcggatcagcatgtcgcggtgaatacgttcccgggtcttgtacacaccgcccgtcacaccatgggagcgggtttcaccagaagtaggtagcttaaccgcaaggagggcgcttaccacggtgggattcgtgactggggtgaagtcgtaacaaggtagccgtatcggaaggtgcggctggatcacctcctttctag

SEQ ID NO: 9850 - DNA, 1520 bp, Ureaplasma parvum
  ref <308>: DATABASE ACCESSION NUMBER: NCBI ACCESSION: NZ_AP018561.1
  ref <309>: DATABASE ENTRY DATE: 2019-04-01
  ref <313>: RELEVANT RESIDUES IN SEQ ID NO: (1)..(1520)
aattttaaagagtttgatcctggctcaggattaacgctggcggcatgcctaatacatgcaaatcgaacgaagccttttaggcttagtggtgaacgggtgagtaacacgtatccaatctacccttaagttggggataactagtcgaaagattagctaataccgaataataacatcaatatcgcatgagaagatgtagaaagtcgctctttgtggcgacgcttttggatgagggtgcgacgtatcagatagttggtgaggtaatggctcaccaagtcaatgacgcgtagctgtactgagaggtagaacagccacaatgggactgagacacggcccatactcctacgggaggcagcagtagggaatttttcacaatgggcgcaagccttatgaagcaatgccgcgtgaacgatgaaggtcttatagattgtaaagttcttttatatgggaagaaacgctaaaataggaaatgattttagtttgactgtaccatttgaataagtatcggctaactatgtgccagcagccgcggtaatacataggatgcaagcgttatccggatttactgggcgtaaaacgagcgcaggcgggtttgtaagtttggtattaaatctagatgcttaacgtctagctgtatcaaaaactgtaaacctagagtgtagtagggagttggggaactccatgtggagcggtaaaatgcgtagatatatggaagaacaccggtggcgaaggcgccaacttggactatcactgacgcttaggctcgaaagtgtggggagcaaataggattagataccctagtagtccacaccgtaaacgatcatcattaaatgtcggcccgaatgggtcggtgttgtagctaacgcattaaatgatgtgcctgggtagtacattcgcaagaatgaaactcaaacggaattgacggggacccgcacaagtggtggagcatgttgcttaatttgacaatacacgtagaaccttacctaggtttgacatctattgcgatgctatagaaatatagttgaggttaacaatatgacaggtggtgcatggttgtcgtcagctcgtgtcgtgagatgttgggttaagtcccgcaacgagcgcaacccctttcgttagttacttttctagcgatactgctaccgcaaggtagaggaaggtggggatgacgtcaaatcatcatgccccttatatctagggctgcaaacgtgctacaatggctaatacaaactgctgcaaaatcgtaagatgaagcgaaacagaaaaagttagtctcagttcggatagagggctgcaattcgtcctcttgaagttggaatcactagtaatcgcgaatcagacatgtcgcggtgaatacgttctcgggtcttgtacacaccgcccgtcaaactatgggagctggtaatatctaaaaccgcaaagctaaccttttggaggcatgcgtctagggtaggatcggtgactggagttaagtcgtaacaaggtatccctacgagaacgtggggatggatcacctcctttct

SEQ ID NO: 9851 - DNA, 1554 bp, Ureibacillus thermosphaericus
  ref <308>: DATABASE ACCESSION NUMBER: NCBI ACCESSION: NZ_AP018335.1
  ref <309>: DATABASE ENTRY DATE: 2019-04-01
  ref <313>: RELEVANT RESIDUES IN SEQ ID NO: (1)..(1554)
ttatggagagtttgatcctggctcaggacgaacgctggcggcgtgcctaatacatgcaagtcgagcgaaccaattgaaagcctagctttcatgaggttagcggcggacgggtgagtaacacgtgggtaacctgccctatagactgggataactcgcggaaacgcgtgctaataccggataacacatcaaagtgcatgctttggtgttgaaagatggttctgctatcactataggatgggcccgcggcgcattagcttgttggtggggtaacggcctaccaaggcgacgatgcgtagccgacctgagagggtgatcggccacactgggactgagacacggcccagactcctacgggaggcagcagtagggaatcttccacaatgggcgaaagcctgatggagcaacgccgcgtgagcgaagaaggtcttcggatcgtaaagctctgttgtaagggaagaacaagtgcagtagtaactggctgcaccttgacggtaccttactagaaagccacggctaactacgtgccagcagccgcggtaatacgtaggtggcaagcgttgtccggaattattgggcgtaaagcgcgcgcaggcggtttcttaagtctgatgtgaaagcctccggcttaaccggggagggtcattggaaactgggagacttgagtgcaggagagggaagcggaattccatgtgtagcggtgaaatgcgtagagatatggaggaacaccagtggcgaaggcggcttcctggcctgtaactgacgctgaggcgcgaaagcgtggggagcaaacaggattagataccctggtagtccacgccgtaaacgatgagtgctaagtgttagggggtttccaccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctatggagacatagccttcccttcggggacagcggtgacaggtggtgcatggttgtcgtcagctcgtgtcgtgagatgttgggttaagtcccgcaacgagcgcaacccttgtccttagttgccatcattcagttgggcactctaaggagactgccgtacaaatacggaggaaggtggggatgacgtcaaatcatcatgccccttatgacctgggctacacacgtgctacaatggacggtacaaacggtcgcgaagtcgcgagacggagccaatccgaaaaaaccgttctcagttcggattgcaggctgcaactcgcctgcatgaagccggaatcgctagtaatcgcggatcagcatgccgcggtgaatacgttcccgggccttgtacacaccgcccgtcacaccacgagagtctgtaacacccgaagtcggtgaggtaaccctttcgggagccagccgccgaaggtgggacagatgattggggtgaagtcgtaacaaggtagccgtatcggaaggtgcggctggatcacctcctttct

SEQ ID NO: 9852 - DNA, 1533 bp, Urinacoccus sp. Marseille-P3926
  ref <308>: DATABASE ACCESSION NUMBER: NCBI ACCESSION: NZ_OCTU01000001.1
  ref <309>: DATABASE ENTRY DATE: 2019-04-01
  ref <313>: RELEVANT RESIDUES IN SEQ ID NO: (1)..(1533)
tttttaattgagagtttgatcctggctcaggacgaacgctggcggcgcgcctaacacatgcaagtcgagcgatgaaattttaacagatctcttcggagagaagataaaatggattagcggcggacgggtgagtaacacgtgagaaacctgcctttcacaaggggatagcctcgggaaaccgggattaataccctatgacacatttccttcgcatgaaagaaatgttaaaactccggtggtgaaagatggtctcgcgtctgattagctagttggtggggtaatagcctaccaaggccatgatcagtaaccggcctgagagggtgaacggtcacattggaactgagacacggtccaaactcctacgggaggcagcagtggggaatattgcacaatggaggaaactctgatgcagcgacgccgcgtgagcgatgaaggctttcgagtcgtaaagctctgtcctatgggaagataatgacggtaccataggaggaagccccggctaactacgtgccagcagccgcggtaatacgtagggggcgagcgttgtccggaatcactgggcgtaaagggttcgcaggcggtctatcaagtctgatgtgaaaggcatgggcttaacccatgtaagcattggaaactgatagacttgagttaaggagaggtaagtggaattcctagtgtagcggtgaaatgcgtagatattaggaagaataccggtggcgaaggcgacttactggacttaaactgacgctgaggaacgaaagcgtggggagcaaacaggattagataccctggtagtccacgctgtaaacgatgagtgctaggtgtcggggtaactcggtgccgcagttaacacattaagcactccgcctggggagtacgtgcgcaagcatgaaactcaaaggaattgacggggacccgcacaagcagcggagcatgtggtttaattcgaagcaacgcgaagaaccttaccaaggctagacattttattgaccggtctagagatagaccatttcttcggaacagtaaaacaggtggtgcatggttgtcgtcagctcgtgtcgtgagatgttgggttaagtcccgcaacgagcgcaacccttacctttagttgccagcatttcggatgggaactctaaagggactgccgatgataaatcggaggaaggtggggatgacgtcaaatcatcatgccctttatgccttgggctacacacgtgctacaatggtcggtacagagagcagcgagcgagcgatctcaagcgaatctcaaaaagccgatctcagttcggattgcaggctgcaactcgcctgcatgaagtcggagttgctagtaatcgcgaatcagaatgtcgcggtgaatgcgttcccgggtcttgtacacaccgcccgtcacaccatgggagttggtaatacccgaagccgccgagctaaccatttggaggcaggcgtcgaaggtaggatcaatgactggggtgaagtcgtaacaaggtagccgtatcggaaggtgcggctggatcacctcctttctaagga

SEQ ID NO: 9853 - DNA, 1355 bp, Vagococcus acidifermentans
  ref <308>: DATABASE ACCESSION NUMBER: NCBI ACCESSION: NZ_NGKC01000033.1
  ref <309>: DATABASE ENTRY DATE: 2019-04-01
  ref <313>: RELEVANT RESIDUES IN SEQ ID NO: (1)..(1355)
ccggataaaagacgcttcggtgtcactggtggatggacccgcgctgcattagttagttggtggggtaacggcctaccaagaccgtgatgcatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaaactctgttgttagagaagaacaagtgggagagtaactgttctcaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactgggagacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagtaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccgctctggagacagagtcttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatggacagtacaatgagttgcgagaccgcgaggtttagctaatctcttaaagctgttctcagttcggattgcaggctgcaactcgcctgcatgaagtcggaatcgctagtaatcgtggatcagcacgccacggtgaatacgttcccgggccttgtacacaccgcccgtcacaccacgagagtttgtaacacccaaagtcggtgaggtaaccttcgggagccagccgcctaaggtgggatagatgattggggtgaagtcgtaacaaggtagccgtatcggaaggtgcggctggatcacctcctttctaaggaa

SEQ ID NO: 9854 - DNA, 1566 bp, Vagococcus carniphilus
  ref <308>: DATABASE ACCESSION NUMBER: NCBI ACCESSION: NZ_NGKB01000035.1
  ref <309>: DATABASE ENTRY DATE: 2019-04-01
  ref <313>: RELEVANT RESIDUES IN SEQ ID NO: (1)..(1566)
tttattgagagtttgatcctggctcaggacgaacgctggcggcgtgcctaatacatgcaagtcgaacgctttgattttcaccggagcttgctccaccgaaaatcaaagagtggcggacgggtgagtaacacgtgggcaacctgcccaacagagggggataacacttggaaacaggtgctaataccgcataatttgtttttccgcatggaagaataataaaagacgcttcggtgtcactgttggatgggcccgcgctgcattagttagttggtggggtaacggcctaccaagaccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgagagagttactgttctcaccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagccctcggctcaaccgaggaaggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatggacggtacaatgagtcgcaagaccgcgaggtttagctaatctcttaaagccgttctcagttcggattgtaggctgcaactcgcctacatgaagccggaatcgctagtaatcgtggatcagcacgccacggtgaatacgttcccgggccttgtacacaccgcccgtcacaccacgagagtttgtaacacccaaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9855 - DNA, 1567 bp, Vagococcus elongatus
  ref <308>: DATABASE ACCESSION NUMBER: NCBI ACCESSION: NZ_NGKA01000050.1
  ref <309>: DATABASE ENTRY DATE: 2019-04-01
  ref <313>: RELEVANT RESIDUES IN SEQ ID NO: (1)..(1567)
ttattgagagtttgatcctggctcaggacgaacgctggcggcgtgcctaatacatgcaagtcgaacgctttttctttcaccggagcttgctccatcggaagaaaaagagtggcggacgggtgagtaacacgtgggtaacttgcccatcagagggggataacacttggaaacaggtgctaataccgcataactccagtgaccgcatggtcatgggataaaagacgctttcgggtgtcactgatggatggacccgcgctgcattagctagttggtggggtaaaggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaatcagcgggaaagtaactgttcccgccctgacggtatctaaccagaaagccacggctaactacgtgccagcagccgcggtaatacgtaggtggcaagcgttgtccggatttattgggcgtaaagcgagcgcaggcggtttcttaagtctgatgtgaaatcccccggctcaaccggggaaggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagtaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctggagacagagcattcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatggacagtacaatgagttgcgagaccgcgaggtttagctaatctcttaaaactgttctcagttcggattgcaggctgcaactcgcctgcatgaagccggaatcgctagtaatcgcggatcagaacgccgcggtgaatacgttcccgggccttgtacacaccgcccgtcacaccacgagagtttgtaacacccaaagtcggtgaggtaaccttcgggagccagccgcctaaggtgggatagatgattggggtgaagtcgtaacaaggtagccgtatcggaaggtgcggctggatcacctcctttctaaggaa

SEQ ID NO: 9856 - DNA, 1558 bp, Vagococcus entomophilus
  ref <308>: DATABASE ACCESSION NUMBER: NCBI ACCESSION: NZ_NGJZ01000007.1
  ref <309>: DATABASE ENTRY DATE: 2019-04-01
  ref <313>: RELEVANT RESIDUES IN SEQ ID NO: (1)..(1558)
tttaatgagagtttgatcctggctcaggacgaacgctggcggcgtgcctaatacatgcaagtcgaacgaacagagaaagagcttgctctttcaaagtgagtggcggacgggtgagtaacacgtgggtaacctgcccattagagggggataacacttggaaacaggtgctaataccgcataattctttggaccgcatggtctaaagatgaaagacgctttcgggtgtcactaatggatggacccgcgctgcattagttagttggtgaggtaacggctcaccaagaccgtgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaatacgtaggtggcaagcgttgtccggatttattgggcgtaaagcgagcgcaggtggtttcttaagtctgatgtgaaagcccccggcttaaccggggagggtcattggaaactgggagacttgagtgcagaagaggagagtggaattccatgtgtagcggtgaaatgcgtagatatatggaggaacaccagtggcgaaggcgactctctggtctgtaactgacactgaggctcgaaagcgtggggagcaaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatggacagtacaatgagtcgcgaagccgcgaggtggagctaatctcttaaagctgttctcagttcggattgtaggctgcaactcgcctacatgaagccggaatcgctagtaatcgtggatcagcacgccacggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9857 - DNA, 1564 bp, Vagococcus fessus
  ref <308>: DATABASE ACCESSION NUMBER: NCBI ACCESSION: NZ_NGJY01000008.1
  ref <309>: DATABASE ENTRY DATE: 2019-04-01
  ref <313>: RELEVANT RESIDUES IN SEQ ID NO: (1)..(1564)
ttattgagagtttgatcctggctcaggacgaacgctggcggcgtgcctaatacatgcaagtcgaacgcttctccgaaagatgcttgcatctttcatatgagaagagtggcggacgggtgagtaacacgtgggtaacctgccctttagcgggggataacatttggaaacagatgctaataccgcataattggttttgccgcatggcagaactatgaaagacgctttacggtgtcactaaaggatggacccgcgctgcattagttagttggtgaggtaatggctcaccaagaccgtgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgggagagtaactgttcccaccttgacggtatctaaccagaaagccacggctaactacgtgccagcagccgcggtaatacgtaggtggcaagcgttgtccggatttattgggcgtaaagcgagcgcaggcggttctttaagtctgatgtgaaagcccccggctcaaccggggagggtcattggaaactggagaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccattctggagacagaactttcccttcggggacaaagtgacaggtggtgcatggttgtcgtcagctcgtgtcgtgagatgttgggttaagtcccgcaacgagcgcaacccctattgttagttgccatcattaagttgggcactctagcgagactgccggtgataaaccggaggaaggtggggatgacgtcaaatcatcatgccccttatgacctgggctacacacgtgctacaatggatggtacaacgagtcgcaaggtcgcgaggccaagctaatctcttaaagccattctcagttcggattgtaggctgcaactcgcctacatgaagccggaatcgctagtaatcgcggatcagaacgccgcggtgaatacgttcccgggccttgtacacaccgcccgtcacaccacgagagtttgtaacacccgaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9858 - DNA, 881 bp, Vagococcus fluvialis
  ref <308>: DATABASE ACCESSION NUMBER: NCBI ACCESSION: NZ_FWFD01000002.1
  ref <309>: DATABASE ENTRY DATE: 2019-04-01
  ref <313>: RELEVANT RESIDUES IN SEQ ID NO: (1)..(881)
ttattgagagtttgatcctggctcaggacgaacgctggcggcgtgcctaatacatgcaagtcgaacgctttgatttccaccggagcttgctccatcgggaatcagagagtggcggacgggtgagtaacacgtgggcaacctgcccaacagagggggataacacttggaaacaggtgctaataccgcataatttgttttcccgcatgggagaataataaaagacgcttcggtgtcactgttggatgggcccgcgctgcattagttagttggtggggtaatggcctaccaagaccgtgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgggagagtaactgttcccaccttgacggtatctaaccagaaagccacggctaactacgtgccagcagccgcggtaatacgtaggtggcaagcgttgtccggatttattgggcgtaaagcgagcgcaggcggtcttttaagtctgatgtgaaagccctcggctcaaccgaggaaggtcattggaaactggaggacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagttaa

SEQ ID NO: 9859 - DNA, 1570 bp, Vagococcus humatus
  ref <308>: DATABASE ACCESSION NUMBER: NCBI ACCESSION: NZ_PXZH01000010.1
  ref <309>: DATABASE ENTRY DATE: 2019-04-01
  ref <313>: RELEVANT RESIDUES IN SEQ ID NO: (1)..(1570)
tttattgagagtttgatcctggctcaggacgaacgctggcggcgtgcctaatacatgcaagtcgaacgcttctacttccaccgagtgcttgcactcaccggaagaagaggagtggcggacgggtgagtaacacgtgggcaacctgcctatcagagggggataacacttggaaacaggtgctaataccgcataattatctagaccacatggtctggacatgaaagacgctttcgggtgtcactgatagatgggcccgcgctgcattagctagttggtagggtaacggcctaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggataagagtaactgtttatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggcttaaccggggagggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccacccttcagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatggacagtacaatgagctgcaagaccgcgaggtcaagctaatctcttaaagctgttctcagttcggattgtaggctgcaactcgcctacatgaagccggaatcgctagtaatcgcggatcagaacgccgcggtgaatacgttcccgggccttgtacacaccgcccgtcacaccacgagagtttgtaacacccaaagtcggtgaggtaaccttcgggagccagccgcctaaggtgggatggatgattggggtgaagtcgtaacaaggtagccgtatcggaaggtgcggctggatcacctcctttctaaggaa

SEQ ID NO: 9860 - DNA, 1568 bp, Vagococcus lutrae
  ref <308>: DATABASE ACCESSION NUMBER: NCBI ACCESSION: NZ_NGJW01000022.1
  ref <309>: DATABASE ENTRY DATE: 2019-04-01
  ref <313>: RELEVANT RESIDUES IN SEQ ID NO: (1)..(1568)
tttaatgagagtttgatcctggctcaggacgaacgctggcggcgtgcctaatacatgcaagtcgaacgcttctttttcaccgggtgcttgcacccaccgagaaagaggagtggcggacgggtgagtaacacgtgggcaacctgcccatcagagggggataacacttggaaacaggtgctaataccgcataattctttttgtcgcctgacagagagataaaagacgctttcgggtgtcactgatggatgggcccgcgctgcattagctagttggtggggtaaaggctcaccaaggccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgagagagtaactgttctcaccttgacggtatctaaccagaaagccacggctaactacgtgccagcagccgcggtaatacgtaggtggcaagcgttgtccggatttattgggcgtaaagcgagcgcaggcggttccttaagtctgatgtgaaagcccccggctcaaccggggaaggtcattggaaactggggaacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagtaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatggacagtacaatgagttgcgagaccgcgaggtttagctaatctcttaaagctgttctcagttcggattgcaggctgcaactcgcctgcatgaagccggaatcgctagtaatcgcggatcagaacgccgcggtgaatacgttcccgggccttgtacacaccgcccgtcacaccacgagagtttgtaacacccaaagtcggtgaggtaaccttcgggagccagccgcctaaggtgggatggatgattggggtgaagtcgtaacaaggtagccgtatcggaaggtgcggctggatcacctcctttctaaggaa

SEQ ID NO: 9861 - DNA, 1568 bp, Vagococcus martis
  ref <308>: DATABASE ACCESSION NUMBER: NCBI ACCESSION: NZ_MVAB01000001.1
  ref <309>: DATABASE ENTRY DATE: 2019-04-01
  ref <313>: RELEVANT RESIDUES IN SEQ ID NO: (1)..(1568)
ttttattgagagtttgatcctggctcaggacgaacgctggcggcgtgcctaatacatgcaagtcgaacgcatttcttttcaccggagcttgctccaccgaaaagaaatgagtggcggacgggtgagtaacacgtgggcaacctgcccatcagagggggataacacttggaaacaggtgctaataccgcataattgattttgccgcatggcgagatcataaaagacgctttaagtgtcgctgatggatgggcccgcggtgcattagttagttggtggggtaacggcctaccaagaccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgatagagtaactgttatcaccttgacggtatctaaccagaaagccacggctaactacgtgccagcagccgcggtaatacgtaggtggcaagcgttgtccggatttattgggcgtaaagcgagcgcaggcggtcttttaagtctgatgtgaaagccctcggctcaaccgaggaaggtcattggaaactggaggacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatggacagtacaatgagttgcgagaccgcgaggtttagctaatctcttaaagctgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccaaagtcggtgaggtaaccttttggagccagccgcctaaggtgggatagatgattggggtgaagtcgtaacaaggtagccgtatcggaaggtgcggctggatcacctcctttctaaggaa

SEQ ID NO: 9862 - DNA, 1462 bp, Vagococcus penaei
  ref <308>: DATABASE ACCESSION NUMBER: NCBI ACCESSION: NZ_NGJV01000047.1
  ref <309>: DATABASE ENTRY DATE: 2019-04-01
  ref <313>: RELEVANT RESIDUES IN SEQ ID NO: (1)..(1462)
aagtgagtggcggacgggtgagtaacacgtgggcaacctgcccatcagagggggataacacttggaaacaggtgctaataccgcataattcctattgccgcatggcgacaggataaaagacgcttcggtgtcactggtggatgggcccgcggtgcattagttagttggtggggtaacggcctaccaagaccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgagagagtaactgttctcaccttgacggtatctaaccagaaagccacggctaactacgtgccagcagccgcggtaatacgtaggtggcaagcgttgtccggatttattgggcgtaaagcgagcgcaggtggtcttttaagtctgatgtgaaagccctcggctcaaccgaggaaggtcattggaaactggaggacttgagtgcagaagaggagagtggaattccatgtgtagcggtgaaatgcgtagatatatggaggaacaccagtggcgaaggcgactctctggtctgtaactgacactgaggctcgaaagcgtggggagcaaacaggattagataccctggtagtccacgccgtaaacgatgagtgctaggtgttggagggtttccgcccttcagtgccgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcaagactgccggtgacaaaccggaggaaggtggggatgacgtcaaatcatcatgccccttatgacctgggctacacacgtgctacaatggacagtacaatgagttgcgagaccgcgaggtttagctaatctcttaaagctgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccaaagtcggtgaggtaaccttcgggagccagccgcctaaggtgggatagatgattggggtgaagtcgtaacaaggtagccgtatcggaaggtgcggctggatcacctcctttctaagga

SEQ ID NO: 9863 - DNA, 1562 bp, Vagococcus salmoninarum
  ref <308>: DATABASE ACCESSION NUMBER: NCBI ACCESSION: NZ_NGJU01000043.1
  ref <309>: DATABASE ENTRY DATE: 2019-04-01
  ref <313>: RELEVANT RESIDUES IN SEQ ID NO: (1)..(1562)
ttattgagagtttgatcctggctcaggacgaacgctggcggcgtgcctaatacatgcaagtcgaacgcacgaagttgaagagcttgctctttaacctagtgagtggcggacgggtgagtaacacgtgggtaacctgcccattagagggggataacacttggaaacaggtgctaataccgcataattgttttagccgcatggctgagatatgaaagacgctttcgggtgtcactaatggatggacccgcgctgcattagttagttggtgaggtaatggctcaccaagaccgtgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgggagagtaactgttcccaccttgacggtatctaaccagaaagccacggctaactacgtgccagcagccgcggtaatacgtaggtggcaagcgttgtccggatttattgggcgtaaagcgagcgcaggtggttctttaagtctgatgtgaaagcccccggctcaaccggggagggtcattggaaactggggaacttgagtgcagaagaggagagtggaattccatgtgtagcggtgaaatgcgtagatatatggaggaacaccagtggcgaaggcgactctctggtctgtaactgacactgaggctcgaaagcgtggggagcaaacaggattagataccctggtagtccacgccgtaaacgatgagtgctaagtgttggagggtttccgcccttcagtgctgcagttaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccttgaccacttgagagatcaagctttcccttcggggacaaggtgacaggtggtgcatggttgtcgtcagctcgtgtcgtgagatgttgggttaagtcccgcaacgagcgcaacccctattgttagttgccatcattaagttgggcactctagcgagactgccggtgataaaccggaggaaggtggggatgacgtcaaatcatcatgccccttatgacctgggctacacacgtgctacaatggacagtacaatgagttgcgagaccgcgaggtttagctaatctcttaaagctgttctcagttcggattgtaggctgcaactcgcctacatgaagccggaatcgctagtaatcgtggatcagaacgccacggtgaatacgttcccgggccttgtacacaccgcccgtcacaccacgaaagtttgtagcacccgaaatcggtgaggtaacccttgtggagccagccgcctaaggtgagatagatgattggggtgaagtcgtaacaaggtagccgtatcggaaggtgcggctggatcacctcctttctaaggaa

SEQ ID NO: 9864 - DNA, 1566 bp, Vagococcus sp. AM17-17
  ref <308>: DATABASE ACCESSION NUMBER: NCBI ACCESSION: NZ_QRJY01000008.1
  ref <309>: DATABASE ENTRY DATE: 2019-04-01
  ref <313>: RELEVANT RESIDUES IN SEQ ID NO: (1)..(1566)
tttattgagagtttgatcctggctcaggacgaacgctggcggcgtgcctaatacatgcaagtcgaacgcatttcctttcaccggagcttgctccaccgaaaagaaatgagtggcggacgggtgagtaacacgtgggcaacctgcccatcagagggggataacacttggaaacaggtgctaataccgcataattgattttaccgcatggcgaaatcataaaagacgctttaagtgtcactgatggatgggcccgcggtgcattagttagttggtggggtaatggcctaccaagaccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaataagtgatagagtaactgttatcaccttgacggtatctaaccagaaagccacggctaactacgtgccagcagccgcggtaatacgtaggtggcaagcgttgtccggatttattgggcgtaaagcgagcgcaggcggtcttttaagtctgatgtgaaagccctcggctcaaccgaggaaggtcattggaaactggaggacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatggacagtacaatgagttgcaagaccgcgaggtttagctaatctcttaaagctgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccaaagtcggtgaggtaaccttttggagccagccgcctaaggtgggatagatgattggggtgaagtcgtaacaaggtagccgtatcggaaggtgcggctggatcacctcctttctaagga

SEQ ID NO: 9865 - DNA, 1565 bp, Vagococcus sp. SS1994
  ref <308>: DATABASE ACCESSION NUMBER: NCBI ACCESSION: NZ_NGJT01000053.1
  ref <309>: DATABASE ENTRY DATE: 2019-04-01
  ref <313>: RELEVANT RESIDUES IN SEQ ID NO: (1)..(1565)
tttattgagagtttgatcctggctcaggacgaacgctggcggcgtgcctaatacatgcaagtcgaacgcatttcttttcatcggagcttgctccaccgaaaagaaatgagtggcggacgggtgagtaacacgtgggcaacctgcccatcagagggggataacacttggaaacaggtgctaataccgcataattgcttttgccgcatggtgagagtataaaagacgcttcggtgtcactggtggatgggcccgcggtgcattagttagttggtggggtaacggcctaccaagaccgtgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgatagagtaactgttatcaccttgacggtatctaaccagaaagccacggctaactacgtgccagcagccgcggtaatacgtaggtggcaagcgttgtccggatttattgggcgtaaagcgagcgcaggcggtcttttaagtctgatgtgaaagccctcggctcaaccgaggaaggtcattggaaactggaggacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatggacagtacaatgagttgcgagaccgcgaggtttagctaatctcttaaagctgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccaaagtcggtgaggtaaccttttggagccagccgcctaaggtgggatagatgattggggtgaagtcgtaacaaggtagccgtatcggaaggtgcggctggatcacctcctttctaagga

SEQ ID NO: 9866 - DNA, 1565 bp, Vagococcus sp. SS1995
  ref <308>: DATABASE ACCESSION NUMBER: NCBI ACCESSION: NZ_NGJS01000038.1
  ref <309>: DATABASE ENTRY DATE: 2019-04-01
  ref <313>: RELEVANT RESIDUES IN SEQ ID NO: (1)..(1565)
tttattgagagtttgatcctggctcaggacgaacgctggcggcgtgcctaatacatgcaagtcgaacgcatttcttttcaccggagcttgctccaccgaaaagaaatgagtggcggacgggtgagtaacacgtgggcaacctgcccatcagagggggataacacttggaaacaggtgctaataccgcataattcctgttgtcgcatggcaacaggataaaagacgcttcggtgtcactggtggatgggcccgcggtgcattagttagttggtggggtaacggcctaccaagaccatgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaagtgggagagtaactgttcccgccttgacggtatctaaccagaaagccacggctaactacgtgccagcagccgcggtaatacgtaggtggcaagcgttgtccggatttattgggcgtaaagcgagcgcaggcggtcttttaagtctgatgtgaaagccctcggctcaaccgaggaaggtcattggaaactggaggacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaggtgttggagggtttccgcccttcagtgccgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcattcagttgggcactctagcaagactgccggtgacaaaccggaggaaggtggggatgacgtcaaatcatcatgccccttatgacctgggctacacacgtgctacaatggacagtacaatgagttgcgagaccgcgaggtttagctaatctcttaaagctgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccaaagtcggtgaggtaaccttcgggagccagccgcctaaggtgggatagatgattggggtgaagtcgtaacaaggtagccgtatcggaaggtgcggctggatcacctcctttctaagga

SEQ ID NO: 9867 - DNA, 1567 bp, Vagococcus teuberi
  ref <308>: DATABASE ACCESSION NUMBER: NCBI ACCESSION: NZ_CP017267.1
  ref <309>: DATABASE ENTRY DATE: 2019-04-01
  ref <313>: RELEVANT RESIDUES IN SEQ ID NO: (1)..(1567)
ttttattgagagtttgatcctggctcaggacgaacgctggcggcgtgcctaatacatgcaagtcgaacgcatttcttttcaccggagcttgctccaccgaaaagaaatgagtggcggacgggtgagtaacacgtgggcaacctgcccatcagagggggataacacttggaaacaggtgctaataccgcataattgattttaccgcatggtggaatcataaaagacgctttaagtgtcactgatggatgggcccgcggtgcattagttagttggtggggtaatggcctaccaagaccatgatgcatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaaactctgttgttagagaagaataagtgatagagtaactgttatcaccttgacggtatctaaccagaaagccacggctaactacgtgccagcagccgcggtaatacgtaggtggcaagcgttgtccggatttattgggcgtaaagcgagcgcaggcggtcttttaagtctgatgtgaaagccctcggctcaaccgaggaaggtcattggaaactggaggacttgagtgcagaagaggagagtggaattccatgtgtagcggtgaaatgcgtagatatatggaggaacaccagtggcgaaggcgactctctggtctgtaactgacgctgaggctcgaaagcgtggggagcaaacaggattagataccctggtagtccacgccgtaaacgatgagtgctaagtgttggagggtttccgcccttcagtgctgcagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctttgaccactctagagatagagctttcccttcggggacaaagtgacaggtggtgcatggttgtcgtcagctcgtgtcgtgagatgttgggttaagtcccgcaacgagcgcaacccttattgttagttgccatcattcagttgggcactctagcgagactgccggtgacaaaccggaggaaggtggggatgacgtcaaatcatcatgccccttatgacctgggctacacacgtgctacaatggacagtacaatgagttgcgagaccgcgaggtttagctaatctcttaaagctgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccaaagtcggtgaggtaaccttttggagccagccgcctaaggtgggatagatgattggggtgaagtcgtaacaaggtagccgtatcggaaggtgcggctggatcacctcctttctaagga

SEQ ID NO: 9868 - DNA, 1243 bp, Vallitalea sp. S15
  ref <308>: DATABASE ACCESSION NUMBER: NCBI ACCESSION: NZ_PQDH01000052.1
  ref <309>: DATABASE ENTRY DATE: 2019-04-01
  ref <313>: RELEVANT RESIDUES IN SEQ ID NO: (1)..(1243)
acgatcagtagccggcctgagagggtggacggccacattgggactgagacacggcccaaactcctacgggaggcagcagtggggaatattgcacaatgggggaaaccctgatgcagcgacgccgcgtgaaggaagaaggttttcggatcgtaaacttctatcagcagggaagaaaatgacggtacctgactaagaagccccggctaactacgtgccagcagccgcggtaatacgtagggggcaagcgttatccggaatcactgggtgtaaagggtgcgtaggcggcaaggtaagtcagatgtgaaagcccggggctcaactccgggactgcatttgaaactactttgctagagtgcaggagaggaaagtggaattcctagtgtagcggtgaaatgcgtagatattaggaggaacaccagtggcgaaggcggctttctggactgtaactgacgctgaggcacgaaagcgtggggagcgaacaggattagataccctggtagtccacgccgtaaacgatgaatgctaggtgtcgggggtcaaacctcggtgccgcagctaacgcattaagcattccacctggggagtacgatcgcaagattgaaactcaaaggaattgacggggacccgcacaagcggtggagcatgtggtttaattcgaagcaacgcgaagaaccttaccaaatcttgacatccttctgatcgcaccttaatcggtgttttccttcgggacagaagagacaggtggtgcatggttgtcgtcagctcgtgtcgtgagatgttgggttaagtcccgcaacgagcgcaacccttgtctttagtagccagcatttcggatggggactctagagagactgccggggacaactcggaggaaggtggggatgacgtcaaatcatcatgccccttatgatttgggctacacacgtgctacaatggtgactacaaagggaggctaagccgcgaggtgaagcaaaccccataaaggtcatcccagttcggattgtagtctgcaactcgactacatgaagttggaatcgctagtaatcgcgaatcagaatgtcgcggtgaatacgttcccgggtcttgtacacaccgcccgtcacaccacggaagtcggagacgcccgaagccagtgacccaacctatggagggagctgtcgaaggtggagtcgatgactggggtgaagtcgtaacaaggtagccgtatcggaaggtgcggctggatcacctcctttctaaggaa

SEQ ID NO: 9869 - DNA, 1595 bp, Vampirococcus sp. LiM
  ref <308>: DATABASE ACCESSION NUMBER: NCBI ACCESSION: NZ_CP019384.1
  ref <309>: DATABASE ENTRY DATE: 2019-04-01
  ref <313>: RELEVANT RESIDUES IN SEQ ID NO: (1)..(1595)
tttcggagagtttgatcctggctcagagtgaacgctggcggcgtggattaggcatgcaagtcgagcgatgcggatttatgagtaaggccgaccgcaaggaaggttttacaagtggatttgcatagcggcaaacgggtgagtaacacgtgagcaatctacccctaggactggaatagcccggagaaatccggggtaatgacagatgtgactacgatctctcatgaggacgtagtaaaagacggggacttgtcgcaagacaggcccgtcaccaagggaggagctcgcggcctatcagcttgttggtgaggtaatggcccaccaaggcgaagacgggtagctagtctgagaggatgtttagccacactggaactgagacactgtccagactcctacgggaggctgcagtcgagaatctttagcaatgggggaaaccctgactatgcgacgccgcgtgagggatgaaggtcttcggattgtaaacctctttcgaccggaaagaatatcctgacgggtaatatccgtcaggactgacggtaccgggagaagaagccacggccaactccgtgccagcagccgcggtaatacggaggtggcgagcgttactcggatttattgggtgtaaagggcaggtaggcggcctgacaagtggggagtgaaatcctgcggcttaatcgcagaactgctttccaaactatcgggcttgagtgtgggagaggagaatggaactcctggtgtaagggtgaaatctgtagagatcaggaggaacaccattggcgaaggcgattctctggaccacaactgacgctgaactgcgaaagctaggggagagaacaggattagataccctggtattcctagccgtaaacgatgagtactgggtgtttcgggttaaaccgaagcgccgaagttaacacattaagtactccacctggggactacggccgcaaggttgaaactcaaaggaattgacgggggcccgcacaagcagtggaacatgtggttcaattcgacgctacgcgaagaacctcaccagggtttgacatataggtagtaggaacctgaaagggggacgactcgttaagccgagtgcctatacaggtgttgcatggctgtcgtcagctcgtgccgtgaggtgttgggttaagtcccgcaacgagcgcaaccatcatccttagttgctaccgaaggatccgaaagggttctggcgagcactctaaggagactgcccgtgataaacgggaggaaggtggagatgacgtcaagtccgtatggcccttataccctgggctacacacgtgttacaatgggatgtacagagcgttgccaaaccgcgaggtggagctaatcgcaaaaagcatcccccagttcagattggagtctgcaacccgactccatgaagttggaattgctagtaacggcggatcagctacgccgccgtgaatacgttcccgggccttgtacacaccgcccgtcaagcgatgggagccggtagtacccgaagtggcgacaacgcccctaaggtaagactggtgactggcgctaagtcgtaacaaggtagccgtatcggaaggtgcggctggatcacctcctttcta

SEQ ID NO: 9870 - DNA, 1549 bp, Varibaculum sp. Marseille-P5644
  ref <308>: DATABASE ACCESSION NUMBER: NCBI ACCESSION: NZ_UWNY01000001.1
  ref <309>: DATABASE ENTRY DATE: 2019-04-01
  ref <313>: RELEVANT RESIDUES IN SEQ ID NO: (1)..(1549)
tttgttggagagtttgatcctggctcaggatgaacgctggcggcgtgcttaacacatgcaagtcgaacgggatccaagggtgcttgcacttttggtgagagtggcgaacgggtgagtaacacgtgagtaacctgtccttttctttgggataagcttccgaaagggtgtttaataccttatgttctgtctgcctcgcatggggtgggtgggaaaggcttttggccggaattgggtgggctcgcggtctatcagcttgttggtggggtgatggcttaccaaggctttgacgggtagccggcctgagagggtggtcggtcacattgggactgagatacggcccagactcctgcgggaggcagcagtgggggatattgcacaatgggcgaaagcctgatgcagcgacgccgcgtgggggatgaaggccttcgggttgtaaactccttttgctctgaacaaggcatgccaatgggtgtgttgagtgtaggggttgattagcgccggctaactacgtgccagcagccgcggtaatacgtagggcgcgagcgttgtccggaattattgggcgtaaagggcttgtaggtggctggttgcgtctgtcgtgaaagctcatggcttaactgtgggtttgcggtgggtacgggctggcttgagtgcagtaggggagactggaattcctggtgtagcggtggaatgcgcagatatcaggaggaataccggtggcgaaggcgggtctctgggctgttactgacgctgaggagcgaaagcgtggggagcgaacaggattagataccctggtagtccatgctgtaaacgttgggaactgggtgtggggggcttttttgtcttctgcgtcgtagctaacgcgttaagttccccgcctggggagtacggtcgcaaggctaaaactcaaaggaattgacgggggcccgcacaagcggcggagcatgcggattaattcgatgcaacgcgaagaaccttaccaaggcttgacatgcactggaccgatccagagatgggttttcctttttggctggtgtgcaggtggtgcatggttgtcgtcagctcgtgtcgtgagatgttgggttaagtcccgcaacgagcgcaacccttgtcctatgttgccagcaagttgtgttggggactcgtgggagactgccggggttaactcggaggaaggtggggatgacgtcaaatcatcatgccccttatgtcttgggcttcacgcatgctacattggcgtctacaaagggttgcgataccgtgaggtggtgcgaatctcttaaagggcgtcttggttcggatcggggtctgcaactcggccccgtgaaggtggagtcgctagtaatcgcagatcagcaacgctgcggtgaatacgttctcgggccttgtacacaccgcccgtcacgtcacgaaagttggtaacactcgaagcttgtggcctaactctttttgagggggagcgggtgaaggtggggctagcgattgggacgaagtcgtaacaaggtagccgtaccggaaggtgcggctggatcacctcctttctagggag

SEQ ID NO: 9871 - DNA, 1543 bp, Variovorax gossypii
  ref <308>: DATABASE ACCESSION NUMBER: NCBI ACCESSION: NZ_RXOE01000007.1
  ref <309>: DATABASE ENTRY DATE: 2019-04-01
  ref <313>: RELEVANT RESIDUES IN SEQ ID NO: (1)..(1543)
agatcgaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggaccgcaaggccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaacggccttttctaataaagagggctaatgacggtaccgtaagaataagcaccggctaactacgtgccagcagccgcggtaatacgtagggtgcaagcgttaatcggaattactgggcgtaaagcgtgcgcaggcggtgatgtaagacagttgtgaaatccccgggctcaacctgggaactgcatctgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttgccagagatggcttagtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctg

SEQ ID NO: 9872 - DNA, 1538 bp, Variovorax guangxiensis
  ref <308>: DATABASE ACCESSION NUMBER: NCBI ACCESSION: NZ_RXFT01000030.1
  ref <309>: DATABASE ENTRY DATE: 2019-04-01
  ref <313>: RELEVANT RESIDUES IN SEQ ID NO: (1)..(1538)
gaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaacggctctttctaataaagagggctaatgacggtaccgtaagaataagcaccggctaactacgtgccagcagccgcggtaatacgtagggtgcaagcgttaatcggaattactgggcgtaaagcgtgcgcaggcggtgatgtaagacagttgtgaaatccccgggctcaacctgggaactgcatctgtgactgcattgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttgccagagatggcttagtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctg

SEQ ID NO: 9873 - DNA, 1543 bp, Variovorax sp. 369
  ref <308>: DATABASE ACCESSION NUMBER: NCBI ACCESSION: NZ_RXHT01000031.1
  ref <309>: DATABASE ENTRY DATE: 2019-04-01
  ref <313>: RELEVANT RESIDUES IN SEQ ID NO: (1)..(1543)
agatcgaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaacggctctttctaataaagagggctaatgacggtaccgtaagaataagcaccggctaactacgtgccagcagccgcggtaatacgtagggtgcaagcgttaatcggaattactgggcgtaaagcgtgcgcaggcggtgatgtaagacagttgtgaaatccccgggctcaacctgggaactgcatctgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttgccagagatggcttagtgctcgaaagagaaccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctg

SEQ ID NO: 9874 - DNA, 1538 bp, Variovorax sp. 502
  ref <308>: DATABASE ACCESSION NUMBER: NCBI ACCESSION: NZ_RXFQ01000005.1
  ref <309>: DATABASE ENTRY DATE: 2019-04-01
  ref <313>: RELEVANT RESIDUES IN SEQ ID NO: (1)..(1538)
gaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaacggccttttctaataaagagggctaatgacggtaccgtaagaataagcaccggctaactacgtgccagcagccgcggtaatacgtagggtgcaagcgttaatcggaattactgggcgtaaagcgtgcgcaggcggtaatgtaagacagttgtgaaatccccgggctcaacctgggaactgcatctgtgactgcattgctggagtatggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaattcgccagagatggcttagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctg

SEQ ID NO: 9875 - DNA, 1538 bp, Variovorax sp. 553
  ref <308>: DATABASE ACCESSION NUMBER: NCBI ACCESSION: NZ_RXFR01000038.1
  ref <309>: DATABASE ENTRY DATE: 2019-04-01
  ref <313>: RELEVANT RESIDUES IN SEQ ID NO: (1)..(1538)
gaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaacggccttttctaataaagagggctaatgacggtaccgtaagaataagcaccggctaactacgtgccagcagccgcggtaatacgtagggtgcaagcgttaatcggaattactgggcgtaaagcgtgcgcaggcggtgatgtaagacagttgtgaaatccccgggctcaacctgggaactgcatctgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttgccagagatggcttagtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctg

SEQ ID NO: 9876 - DNA, 1538 bp, Variovorax sp. 679; identical to SEQ ID NO: 9875
  ref <308>: DATABASE ACCESSION NUMBER: NCBI ACCESSION: NZ_RXFS01000038.1
  ref <309>: DATABASE ENTRY DATE: 2019-04-01
  ref <313>: RELEVANT RESIDUES IN SEQ ID NO: (1)..(1538)

SEQ ID NO: 9877 - DNA, 1538 bp, Variovorax sp. DXTD-1
  ref <308>: DATABASE ACCESSION NUMBER: NCBI ACCESSION: NZ_RWKH01000014.1
  ref <309>: DATABASE ENTRY DATE: 2019-04-01
  ref <313>: RELEVANT RESIDUES IN SEQ ID NO: (1)..(1538)
gaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaacggccttttctaataaagagggctaatgacggtaccgtaagaataagcaccggctaactacgtgccagcagccgcggtaatacgtagggtgcaagcgttaatcggaattactgggcgtaaagcgtgcgcaggcggtaatgtaagacagttgtgaaatccccgggctcaacctgggaactgcatctgtgactgcattgctggagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaattcgccagagatggcttagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctg

SEQ ID NO: 9878 - DNA, 1538 bp, Variovorax sp. GV004
  ref <308>: DATABASE ACCESSION NUMBER: NCBI ACCESSION: NZ_QKUE01000031.1
  ref <309>: DATABASE ENTRY DATE: 2019-04-01
  ref <313>: RELEVANT RESIDUES IN SEQ ID NO: (1)..(1538)
gaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaacggccttttctaataaagagggctaatgacggtaccgtaagaataagcaccggctaactacgtgccagcagccgcggtaatacgtagggtgcaagcgttaatcggaattactgggcgtaaagcgtgcgcaggcggttatgtaagacagttgtgaaatccccgggctcaacctgggaactgcatctgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaattcgccagagatggcttagtgctcgaaagagagccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctg

SEQ ID NO: 9879 - DNA, 1538 bp, Variovorax sp. GV014
  ref <308>: DATABASE ACCESSION NUMBER: NCBI ACCESSION: NZ_QEOH01000047.1
  ref <309>: DATABASE ENTRY DATE: 2019-04-01
  ref <313>: RELEVANT RESIDUES IN SEQ ID NO: (1)..(1538)
gaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaacggccttttctaataaagagggctaatgacggtaccgtaagaataagcaccggctaactacgtgccagcagccgcggtaatacgtagggtgcaagcgttaatcggaattactgggcgtaaagcgtgcgcaggcggttatgtaagacagttgtgaaatccccgggctcaacctgggaactgcatctgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaattcgccagagatggcttagtgctcgaaagagaaccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctg

SEQ ID NO: 9880 - DNA, 1538 bp, Variovorax sp. GV035; identical to SEQ ID NO: 9878
  ref <308>: DATABASE ACCESSION NUMBER: NCBI ACCESSION: NZ_QJTM01000029.1
  ref <309>: DATABASE ENTRY DATE: 2019-04-01
  ref <313>: RELEVANT RESIDUES IN SEQ ID NO: (1)..(1538)

SEQ ID NO: 9881 - DNA, 1538 bp, Variovorax sp. GV040; identical to SEQ ID NO: 9878
  ref <308>: DATABASE ACCESSION NUMBER: NCBI ACCESSION: NZ_QAYA01000032.1
  ref <309>: DATABASE ENTRY DATE: 2019-04-01
  ref <313>: RELEVANT RESIDUES IN SEQ ID NO: (1)..(1538)

SEQ ID NO: 9882 - DNA, 1538 bp, Variovorax sp. GV042; identical to SEQ ID NO: 9878
  ref <308>: DATABASE ACCESSION NUMBER: NCBI ACCESSION: NZ_QKLT01000034.1
  ref <309>: DATABASE ENTRY DATE: 2019-04-01
  ref <313>: RELEVANT RESIDUES IN SEQ ID NO: (1)..(1538)

SEQ ID NO: 9883 - DNA, 1538 bp, Variovorax sp. KBW07; identical to SEQ ID NO: 9879
  ref <308>: DATABASE ACCESSION NUMBER: NCBI ACCESSION: NZ_QAJK01000210.1
  ref <309>: DATABASE ENTRY DATE: 2019-04-01
  ref <313>: RELEVANT RESIDUES IN SEQ ID NO: (1)..(1538)

SEQ ID NO: 9884 - DNA, 1543 bp, Variovorax sp. MHTC-1
  ref <308>: DATABASE ACCESSION NUMBER: NCBI ACCESSION: NZ_RWKI01000051.1
  ref <309>: DATABASE ENTRY DATE: 2019-04-01
  ref <313>: RELEVANT RESIDUES IN SEQ ID NO: (1)..(1543)
agatcgaactatagagtttgatcctggctcagattgaacgctggcggcatgccttacacatgcaagtcgaacggcagcacgggagcaatcctggtggcgagtggcgaacgggtgagtaatacatcggaacgtgcccaatcgtgggggataacgcagcgaaagctgtgctaataccgcataagatctacggatgaaagcaggggaccgcaaggccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaaggttctttctaataaagagagctcatgacggtaccgtaagaataagcaccggctaactacgtgccagcagccgcggtaatacgtagggtgcaagcgttaatcggaattactgggcgtaaagcgtgcgcaggcggtgatgtaagacagttgtgaaatccccgggctcaacctgggaactgcatctgtgactgcatcgctggagtacggtagagggggatggaattccgcgtgtagcagtgaaatgcgtagatatgcggaggaacaccgatggcgaaggcaatcccctggacctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttgccagagatggcttagtgctcgaaagagaaccgtaacacaggtgctgcatggctgtcgtcagctcgtgtcgtgagatgttgggttaagtcccgcaacgagcgcaacccttgtcattagttgctacatttagttgggcactctagtgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 9885 - DNA, 1543 bp, Variovorax sp. NFACC29; identical to SEQ ID NO: 9871
  ref <308>: DATABASE ACCESSION NUMBER: NCBI ACCESSION: NZ_FNVM01000044.1
  ref <309>: DATABASE ENTRY DATE: 2019-04-01
  ref <313>: RELEVANT RESIDUES IN SEQ ID NO: (1)..(1543)

SEQ ID NO: 9886 - DNA, 1538 bp, Variovorax sp. PMC12
  ref <308>: DATABASE ACCESSION NUMBER: NCBI ACCESSION: NZ_CP027773.1
  ref <309>: DATABASE ENTRY DATE: 2019-04-01
  ref <313>: RELEVANT RESIDUES IN SEQ ID NO: (1)..(1538)
gaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaacggtcttttctaataaagaaggctaatgacggtaccgtaagaataagcaccggctaactacgtgccagcagccgcggtaatacgtagggtgcaagcgttaatcggaattactgggcgtaaagcgtgcgcaggcggtgatgtaagacagttgtgaaatccccgggctcaacctgggaactgcatctgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaattcgccagagatggcttagtgctcgaaagagaaccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctg

SEQ ID NO: 9887 - DNA, 1538 bp, Variovorax sp. T529
  ref <308>: DATABASE ACCESSION NUMBER: NCBI ACCESSION: NZ_RQXU01000006.1
  ref <309>: DATABASE ENTRY DATE: 2019-04-01
  ref <313>: RELEVANT RESIDUES IN SEQ ID NO: (1)..(1538)
gaactatagagtttgatcctggctcagattgaacgctggcggcatgccttacacatgcaagtcgaacggcagcgcgggagcaatcctggcggcgagtggcgaacgggtgagtaatacatcggaacgtgcccaatcgtgggggataacgcagcgaaagctgtgctaataccgcatacgatctacggatgaaagcaggggatcgcaagaccttgcgcgaatggagcggccgatggcagattaggtagttggtgaggtaaaggctcaccaagccttcgatctgtagctggtctgagaggacgaccagccacactgggactgagacacggcccagactcctacgggaggcagcagtggggaattttggacaatgggcgaaagcctgatccagccatgccgcgtgcaggatgaaggccttcgggttgtaaactgcttttgtacggaacgaaacggccttttctaataaagagggctaatgacggtaccgtaagaataagcaccggctaactacgtgccagcagccgcggtaatacgtagggtgcaagcgttaatcggaattactgggcgtaaagcgtgcgcaggcggtaatgtaagacagttgtgaaatccccgggctcaacctgggaactgcatctgtgactgcattgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaattcgccagagatggcttagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcttaaccgcaaggagggcgattaccacggcagggttcgtgactggggtgaagtcgtaacaaggtagccgtatcggaaggtgcggctggatcacctcctttctg

SEQ ID NO: 9888 - DNA, 1543 bp, Variovorax sp. WS11
  ref <308>: DATABASE ACCESSION NUMBER: NCBI ACCESSION: NZ_PXZZ01000038.1
  ref <309>: DATABASE ENTRY DATE: 2019-04-01
  ref <313>: RELEVANT RESIDUES IN SEQ ID NO: (1)..(1543)
agatcgaactatagagtttgatcctggctcagattgaacgctggcggcatgccttacacatgcaagtcgaacggcagcacgggagcaatcctggtggcgagtggcgaacgggtgagtaatacatcggaacgtgcccaatcgtgggggataacgcagcgaaagctgtgctaataccgcatgagatctacggatgaaagcaggggaccgcaaggccttgcgcgaatggagcggccgatggcagattaggtagttggtgaggtaaaggctcaccaagcctgcgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaaggctttctctaataaagagggctcatgacggtaccgtaagaataagcaccggctaactacgtgccagcagccgcggtaatacgtagggtgcaagcgttaatcggaattactgggcgtaaagcgtgcgcaggcggtgatgtaagacagttgtgaaatccccgggctcaacctgggaactgcatctgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggtcttcactgactcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttgccagagatggcttagtgctcgaaagagaaccgtaacacaggtgctgcatggctgtcgtcagctcgtgtcgtgagatgttgggttaagtcccgcaacgagcgcaacccttgtcattagttgctacatttagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaaaccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 9889 - DNA, 1569 bp, Veillonella atypica
  ref <308>: DATABASE ACCESSION NUMBER: NCBI ACCESSION: NZ_UHIF01000003.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggatcagttagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9890 - DNA, 1568 bp, Veillonella caviae
  ref <308>: DATABASE ACCESSION NUMBER: NCBI ACCESSION: NZ_RQUY01000036.1
  ref <309>: DATABASE ENTRY DATE: 2019-04-01
  ref <313>: RELEVANT RESIDUES IN SEQ ID NO: (1)..(1568)
tggagagtttgatcctggctcaggacgaacgctggcggcgtgcttaacacatgcaagtcgaacggagcgaaatggaagcttgcttctatggaacttagtggcgaacgggtgagtaacgcgtaatcaacctgcccttcagagggggacaacagttggaaacgactgctaataccgcatacgattcaacttcggcatcgaggatgaatgaaaggtggcctctatttataagctatcgctgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcctcttgtgaataattagagggattgacggtaccggaatagaaagccacggctaactacgtgccagcagccgcggtaatacgtaggtggcaagcgttgtccggaattattgggcgtaaagcgcgcgcaggcggattagtcagtctgtcttaaaagttcggggcttaaccccgtgatgggatggaaactgctaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcactttgggtgggaactcatgagagactgccgcagacaatgcggaggaaggcggggatgacgtcaaatcatcatgccccttatgacctgggctacacacgtactacaatgggagttaatagacggaagcgaagccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9891 - DNA, 1569 bp, Veillonella criceti
  ref <308>: DATABASE ACCESSION NUMBER: NCBI ACCESSION: NZ_UHIO01000001.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacggagagcgatggaagcttgcttctgtcaatcttagtggcgaacgggtgagtaacgcgtaaccaacctgcccttcagagggggataacaacgggaaaccgttgctaataccgcgtacgaatggacttcggcatcgaagttcattgaaaggtggcctctatttataagctatcgctgaaggagggggttgcgtctgattagctagttggaggggtaatggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgacggccttcgggttgtaaagctctgttaatcgggacgaatggtctttgtgcgaatagtgcagagatttgacggtaccggaatagaaagccacggctaactacgtgccagcagccgcggtaatacgtaggtggcaagcgttgtccggaattattgggcgtaaagcgcgcgcaggcggtttcgtaagtctgtcttaaaagtgcgaggctcaacctcgtgaggggatggaaactatgaaactagagtatcggagaggaaagcggaattcctagtgtagcggtgaaatgcgtagatattaggaagaacaccagtggcgaaggcggctttctggacgacaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggacgcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9892 - DNA, 1569 bp, Veillonella denticariosi
  ref <308>: DATABASE ACCESSION NUMBER: NCBI ACCESSION: NZ_PPDB01000004.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgacggaagcttgcttccatcaatcttagtggcgaacgggtgagtaacgcgtaatcaacctgcccttcagagggggacaacagttggaaacgactgctaataccgcatacgatctgacctcggcatcgaggatagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttaggaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgaggggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtggggactcatgagagactgccgcagacaatgcggaggaaggcggggatgacgtcaaatcatcatgccccttatgacctgggctacacacgtactacaatgggagttaatagacggaagcgaagccgcgaggtggagcgaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9893 - DNA, 1569 bp, Veillonella dispar
  ref <308>: DATABASE ACCESSION NUMBER: NCBI ACCESSION: NZ_LR134375.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgaggatggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcactttgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9894 - DNA, 1569 bp, Veillonella infantium
  ref <308>: DATABASE ACCESSION NUMBER: NCBI ACCESSION: NZ_PPDD01000011.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggatagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9895 - DNA, 1385 bp, Veillonella magna
  ref <308>: DATABASE ACCESSION NUMBER: NCBI ACCESSION: NZ_AUAN01000035.1
  ref <309>: DATABASE ENTRY DATE: 2019-04-01
  ref <313>: RELEVANT RESIDUES IN SEQ ID NO: (1)..(1385)
tgctttcggcatcgagagtatatgaaaggtggcctctatatataagctatcgctgaaggaggggattgcgtctgattagctagttggaggggtaacggcccaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgacggccttcgggttgtaaagctctgttaatcgggacgaaagagccttgtgtgaataatgcgaggaagtgacggtaccggaatagaaagccacggctaactacgtgccagcagccgcggtaatacgtaggtggcaagcgttgtccggaattattgggcgtaaagcgcgcgcaggcggatgcgtaagtctatcttaaaagtgcggggcttaaccccgtgaggggatggaaactgggcatctagagtatcggagaggaaagcggaattcctagtgtagcggtgaaatgcgtagatattaggaagaacaccagtggcgaaggcggctttctggacgacaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgatcgcaaggttgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtggggactcatgagagactgccgcagacaatgcggaggaaggcggggatgacgtcaagtcatcatgccccttatgacctgggctacacacgtactacaatgggctttaatagagggaagcgaagcggcgacgcggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagtcggtggggtaaccttcgggagccagccgcctaaggtaaagtcgatgattggggtgaagtcgtaacaaggtagccgtatcggaaggtgcggctggatcacctcctttctagggaga

SEQ ID NO: 9896 - DNA, 1567 bp, Veillonella montpellierensis
  ref <308>: DATABASE ACCESSION NUMBER: NCBI ACCESSION: NZ_JRNT01000047.1
  ref <309>: DATABASE ENTRY DATE: 2019-04-01
  ref <313>: RELEVANT RESIDUES IN SEQ ID NO: (1)..(1567)
tggagagtttgatcctggctcaggacgaacgctggcggcgtgcttaacacatgcaagtcgaacgaagagacatgggagcttgctcctatgaatcttagtggcgaacgggtgagtaacgcgtaatcaacctgccctacaatgggggacaacagttggaaacgactgctaataccgcatacgacctacggttggcatcaatcgtaggtgaaaggtggcctctacatgtaagctatcgttgtaggaggggattgcgtctgattagctagttggaggggtaacggcccaccaaggcgatgatcagtagccggtctgagaggatgaacggccacattgggactgagacacggcccaaactcctacgggaggcagcagtggggaatcttccgcaatggacgaaagtctgacggagcaacgccgcgtgagtgatgacggtcttcggattgtaaagctctgttaatcgggacgaatggtttgtgtgcaaatagtgcatagacatgacggtaccggaatagaaagccacggctaactacgtgccagcagccgcggtaatacgtaggtggcaagcgttgtccggaattattgggcgtaaagcgcgcgcaggcggactagccagtcagtcttaaaagttcggggcttaaccccgtgatgggattgaaactactagtctagagtatcggagaggaaagtggaattcctagtgtagcggtgaaatgcgtagatattaggaagaacaccagtggcgaaggcgactttctggacgaacactgacgctgaggcgcgaaagccaggggagcgaacgggattagataccccggtagtcctggccgtaaacgatgggtactaagtgtgggaggtatcgaccccttccgtgctgcagttaacgcaataagtaccccgcctggggagtacggtcgcaagactgaaactcaaaggaattgacgggggcccgcacaagcggtggagtatgtggtttaattcgacgcaacgcgaagaaccttaccaggtcttgacattgatggacagaactagagatagtttttcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaataaagagaagcgaaaccgcgaggtggagcgaacctcacaaacactctctcagttcggattgcaggctgcaactcgcctgcatgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctaggga

SEQ ID NO: 9897 - DNA, 1566 bp, Veillonella ratti
  ref <308>: DATABASE ACCESSION NUMBER: NCBI ACCESSION: NZ_RQUX01000035.1
  ref <309>: DATABASE ENTRY DATE: 2019-04-01
  ref <313>: RELEVANT RESIDUES IN SEQ ID NO: (1)..(1566)
ttggagagtttgatcctggctcaggacgaacgctggcggcgtgcttaacacatgcaagtcgaacggagatagatggaagcttgcttctatacttagtggcgaacgggtgagtaacgcgtaaccaacctgcccttcagagggggataacaacgggaaaccgttgctaataccgcgtacgaatgaacttcggcatcggagctcattgaaaggtggcctctatttataagctatcgctgaaggagggggttgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgacggccttcgggttgtaaagctctgttaatcgggacgaatggtctttgtgtgaataatgcaaagatttgacggtaccggaatagaaagccacggctaactacgtgccagcagccgcggtaatacgtaggtggcaagcgttgtccggaattattgggcgtaaagcgcgcgcaggcggtttcataagtctgtcttaaaagtgcggggcttaaccccgtgaggggatggaaactatggaactggagtatcggagaggaaagcggaattcctagtgtagcggtgaaatgcgtagatattaggaagaacaccagtggcgaaggcggctttctggacgacaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaaaccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9898 - DNA, 1570 bp, Veillonella rogosae
  ref <308>: DATABASE ACCESSION NUMBER: NCBI ACCESSION: NZ_PPCX01000007.1
  ref <309>: DATABASE ENTRY DATE: 2019-04-01
  ref <313>: RELEVANT RESIDUES IN SEQ ID NO: (1)..(1570)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaacctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcctcttgcgaatagttagaggaattgacggtaccggaatagaaagccacggctaactacgtgccagcagccgcggtaatacgtaggtggcaagcgttgtccggaattattgggcgtaaagcgcgcgcaggcggatcagttagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9899 - DNA, 1569 bp, Veillonella seminalis
  ref <308>: DATABASE ACCESSION NUMBER: NCBI ACCESSION: NZ_RQUZ01000022.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacggagagagatggaagcttgcttctatcgatcttagtggcgaacgggtgagtaacgcgtaaccaacttgcccttcagagggggataacaacgggaaaccgttgctaataccgcgtacgaatgaacttcggcatcggagctcattgaaaggtggcctctatttataagctatcgctgaaggagggggttgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgacggccttcgggttgtaaagctctgttaatcgggacgaatggtctttgtgtgaataatgcaaagatttgacggtaccggaatagaaagccacggctaactacgtgccagcagccgcggtaatacgtaggtggcaagcgttgtccggaattattgggcgtaaagcgcgcgcaggcggtttcataagtctgtcttaaaagtgcggggcttaaccccgtgaggggatggaaactatggaactggagtatcggagaggaaagcggaattcctagtgtagcggtgaaatgcgtagatattaggaagaacaccagtggcgaaggcggctttctggacgacaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaaaccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9900 - DNA, 1568 bp, Veillonella sp. 3310
  ref <308>: DATABASE ACCESSION NUMBER: NCBI ACCESSION: NZ_RQVJ01000012.1
  ref <309>: DATABASE ENTRY DATE: 2019-04-01
  ref <313>: RELEVANT RESIDUES IN SEQ ID NO: (1)..(1568)
ttggagagtttgatcctggctcaggacgaacgctggcggcgtgcttaacacatgcaagtcgaacggacagacagagagcttgctctcttgaagttagtggcgaacgggtgagtaacgcgtaatcaacctgcccttcagagggggataacaacgggaaaccgttgctaataccgcgtacgattcatagacggcatcgtttgtgaatgaaaggtggcctctatttataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacgtaaaggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9901 - DNA, 1567 bp, Veillonella sp. 3627
  ref <308>: DATABASE ACCESSION NUMBER: NCBI ACCESSION: NZ_RQVG01000018.1
  ref <309>: DATABASE ENTRY DATE: 2019-04-01
  ref <313>: RELEVANT RESIDUES IN SEQ ID NO: (1)..(1567)
ttggagagtttgatcctggctcaggacgaacgctggcggcgtgcttaacacatgcaagtcgaacggacagacagagagcttgctctcttgaagttagtggcgaacgggtgagtaacgcgtaatcaacctgcccttcagagggggataacaacgggaaaccgttgctaataccgcgtacgattcacaggtggcatcgcttgtgaatgaaaggtggcctctatgtataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9902 - DNA, 1568 bp, Veillonella sp. 3891
  ref <308>: DATABASE ACCESSION NUMBER: NCBI ACCESSION: NZ_RQVE01000025.1
  ref <309>: DATABASE ENTRY DATE: 2019-04-01
  ref <313>: RELEVANT RESIDUES IN SEQ ID NO: (1)..(1568)
ttggagagtttgatcctggctcaggacgaacgctggcggcgtgcttaacacatgcaagtcgaacggacgacgagggagcttgctctcttgaagttagtggcgaacgggtgagtaacgcgtaatcaacctgcccttcagagggggataacaacgggaaaccgctgctaataccgcgtacgattcatagacggcatcgtttgtgaatgaaaggtggcctctatttataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtaaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9903 - DNA, 1345 bp, Veillonella sp. 3913
  ref <308>: DATABASE ACCESSION NUMBER: NCBI ACCESSION: NZ_RQVF01000010.1
  ref <309>: DATABASE ENTRY DATE: 2019-04-01
  ref <313>: RELEVANT RESIDUES IN SEQ ID NO: (1)..(1345)
tataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagtggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9904 - DNA, 1568 bp, Veillonella sp. 3960
  ref <308>: DATABASE ACCESSION NUMBER: NCBI ACCESSION: NZ_RQVI01000046.1
  ref <309>: DATABASE ENTRY DATE: 2019-04-01
  ref <313>: RELEVANT RESIDUES IN SEQ ID NO: (1)..(1568)
ttggagagtttgatcctggctcaggacgaacgctggcggcgtgcttaacacatgcaagtcgaacggacgacgagggagcttgctctcttgaagttagtggcgaacgggtgagtaacgcgtaatcaacctgcccttcagagggggataacaacgggaaaccgttgctaataccgcgtacgattcatagacggcatcgtttgtgaatgaaaggtggcctctatttataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtaaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9905 - DNA, 1571 bp, Veillonella sp. 3 1 44
  ref <308>: DATABASE ACCESSION NUMBER: NCBI ACCESSION: NZ_GG770203.1
  ref <309>: DATABASE ENTRY DATE: 2019-04-01
  ref <313>: RELEVANT RESIDUES IN SEQ ID NO: (1)..(1571)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacgtaaaggtggggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9906 - DNA, 1569 bp, Veillonella sp. 6 1 27
  ref <308>: DATABASE ACCESSION NUMBER: NCBI ACCESSION: NZ_GG770219.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcactttgggtggggactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9907 - DNA, 607 bp, Veillonella sp. ACP1
  ref <308>: DATABASE ACCESSION NUMBER: NCBI ACCESSION: NZ_ALKL01000020.1
  ref <309>: DATABASE ENTRY DATE: 2019-04-01
  ref <313>: RELEVANT RESIDUES IN SEQ ID NO: (1)..(607)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggat

SEQ ID NO: 9908 - DNA, 1569 bp, Veillonella sp. AF13-2
  ref <308>: DATABASE ACCESSION NUMBER: NCBI ACCESSION: NZ_QTMT01000010.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggatcggtcagtctgtcttaaaagttcggggcttaaccccgtgatgggatggaaactgctaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcactttgggtggggactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9909 - DNA, 1732 bp, Veillonella sp. AF36-20BH
  ref <308>: DATABASE ACCESSION NUMBER: NCBI ACCESSION: NZ_QTLR01000015.1
  ref <309>: DATABASE ENTRY DATE: 2019-04-01
  ref <313>: RELEVANT RESIDUES IN SEQ ID NO: (1)..(1732)
tggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggaaagatgaaaggtggcctctatgtataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccgaaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtataggtggcaagcgttgtccggaattattgggcgtaaagcgcgcgcaggcggataggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9910 - DNA, 1568 bp, Veillonella sp. AF42-16
  ref <308>: DATABASE ACCESSION NUMBER: NCBI ACCESSION: NZ_QRNT01000081.1
  ref <309>: DATABASE ENTRY DATE: 2019-04-01
  ref <313>: RELEVANT RESIDUES IN SEQ ID NO: (1)..(1568)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggatggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggcctcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9911 - DNA, 1568 bp, Veillonella sp. AM51-8BH; identical to SEQ ID NO: 9910
  ref <308>: DATABASE ACCESSION NUMBER: NCBI ACCESSION: NZ_QSDY01000017.1
  ref <309>: DATABASE ENTRY DATE: 2019-04-01
  ref <313>: RELEVANT RESIDUES IN SEQ ID NO: (1)..(1568)

SEQ ID NO: 9912 - DNA, 1569 bp, Veillonella sp. AS16
  ref <308>: DATABASE ACCESSION NUMBER: NCBI ACCESSION: NZ_AZYX01000006.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgacggaagcttgcttccatcaatcttagtggcgaacgggtgagtaacgcgtaatcaacctgcccttcagagggggacaacagttggaaacgactgctaataccgcatacgatctgacctcggcatcgaggatagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttaggaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgaggggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccttatcttatgttgccagcacttcgggtggggactcatgagagactgccgcagacaatgcggaggaaggcggggatgacgtcaaatcatcatgccccttatgacctgggctacacacgtactacaatgggagttaatagacggaagcgaagccgcgaggtggagcgaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9913 - DNA, 1567 bp, Veillonella sp. CHU110
  ref <308>: DATABASE ACCESSION NUMBER: NCBI ACCESSION: NZ_RQVA01000028.1
  ref <309>: DATABASE ENTRY DATE: 2019-04-01
  ref <313>: RELEVANT RESIDUES IN SEQ ID NO: (1)..(1567)
ttggagagtttgatcctggctcaggacgaacgctggcggcgtgcttaacacatgcaagtcgaacggacagacagagagcttgctctctagaagttagtggcgaacgggtgagtaacgcgtaatcaacctgcccttcagagggggataacaacgggaaaccgttgctaataccgcgtacgattcacgagcggcatcgcttgtgaatgaaaggtggcctctatatataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtaaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9914 - DNA, 1567 bp, Veillonella sp. CHU594
  ref <308>: DATABASE ACCESSION NUMBER: NCBI ACCESSION: NZ_RQVB01000017.1
  ref <309>: DATABASE ENTRY DATE: 2019-04-01
  ref <313>: RELEVANT RESIDUES IN SEQ ID NO: (1)..(1567)
ttggagagtttgatcctggctcaggacgaacgctggcggcgtgcttaacacatgcaagtcgaacggacagacagagagcttgctctcttgaagttagtggcgaacgggtgagtaacgcgtaatcaacctgcccttcagagggggataacaacgggaaaccgttgctaataccgcgtacgattcataagcggcatcgcttgtgaatgaaaggtggcctctatgtataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcactaaaggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9915 - DNA, 1561 bp, Veillonella sp. CHU732
  ref <308>: DATABASE ACCESSION NUMBER: NCBI ACCESSION: NZ_RQVC01000027.1
  ref <309>: DATABASE ENTRY DATE: 2019-04-01
  ref <313>: RELEVANT RESIDUES IN SEQ ID NO: (1)..(1561)
ttggagagtttgatcctggctcaggacgaacgctggcggcgtgcttaacacatgcaagtcgaacggacagacagggagcttgctctcttgaagttagtggcgaacgggtgagtaacgcgtaatcaacctgcccttcagagggggataacaacgggaaaccgttgctaataccgcgtacgattcatgaacggcatcgtttatgaatgaaaggtggcctctatttataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttcta

SEQ ID NO: 9916 - DNA, 1567 bp, Veillonella sp. CHU740
  ref <308>: DATABASE ACCESSION NUMBER: NCBI ACCESSION: NZ_RQVD01000020.1
  ref <309>: DATABASE ENTRY DATE: 2019-04-01
  ref <313>: RELEVANT RESIDUES IN SEQ ID NO: (1)..(1567)
ttggagagtttgatcctggctcaggacgaacgctggcggcgtgcttaacacatgcaagtcgaacggacggacagagagcttgctctcttgaagttagtggcgaacgggtgagtaacgcgtaatcaacctgcccttcagagggggataacaacgggaaaccgttgctaataccgcgtacgattcacgagcggcatcgcttgtgaatgaaaggtggcctctattcataagctatcgctgaaggaggggattgcgtctgattagctagttggaggggtaatggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggatgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9917 - DNA, 1567 bp, Veillonella sp. CNR 79 14
  ref <308>: DATABASE ACCESSION NUMBER: NCBI ACCESSION: NZ_RQVH01000040.1
  ref <309>: DATABASE ENTRY DATE: 2019-04-01
  ref <313>: RELEVANT RESIDUES IN SEQ ID NO: (1)..(1567)
ttggagagtttgatcctggctcaggacgaacgctggcggcgtgcttaacacatgcaagtcgaacggacagacagagagcttgctctcttgaagttagtggcgaacgggtgagtaacgcgtaatcaacctgcccttcagagggggataacaacgggaaaccgttgctaataccgcgtacgattcataagcggcatcgcttgtgaatgaaaggtggcctctatgtataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagctagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9918 - DNA, 1367 bp, Veillonella sp. DNF00869
  ref <308>: DATABASE ACCESSION NUMBER: NCBI ACCESSION: NZ_KQ960756.1
  ref <309>: DATABASE ENTRY DATE: 2019-04-01
  ref <313>: RELEVANT RESIDUES IN SEQ ID NO: (1)..(1367)
tgaatgaaaggtggcctctatgtataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagctgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9919 - DNA, 1569 bp, Veillonella sp. HPA0037
  ref <308>: DATABASE ACCESSION NUMBER: NCBI ACCESSION: NZ_KE150483.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagaacgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcaaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9920 - DNA, 1569 bp, Veillonella sp. ICM51a
  ref <308>: DATABASE ACCESSION NUMBER: NCBI ACCESSION: NZ_JAPX01000049.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgagactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcaaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9921 - DNA, 1570 bp, Veillonella sp. S13053-19
  ref <308>: DATABASE ACCESSION NUMBER: NCBI ACCESSION: NZ_PPDA01000004.1
  ref <309>: DATABASE ENTRY DATE: 2019-04-01
  ref <313>: RELEVANT RESIDUES IN SEQ ID NO: (1)..(1570)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcttcttgcgaatagttagaagaattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9922 - DNA, 1570 bp, Veillonella sp. S13054-11
  ref <308>: DATABASE ACCESSION NUMBER: NCBI ACCESSION: NZ_PPCY01000007.1
  ref <309>: DATABASE ENTRY DATE: 2019-04-01
  ref <313>: RELEVANT RESIDUES IN SEQ ID NO: (1)..(1570)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggatagatgaaaggtggcctctacatgtaagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagtgagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9923 - DNA, 1569 bp, Veillonella sp. T11011-6
  ref <308>: DATABASE ACCESSION NUMBER: NCBI ACCESSION: NZ_PPCW01000004.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaatctcggcatcgaggatagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9924 - DNA, 1569 bp, Veillonella sp. T14073-2
  ref <308>: DATABASE ACCESSION NUMBER: NCBI ACCESSION: NZ_PPDC01000011.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatctaacctcggcatcgaggatagatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaaccagagatggttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcaataccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9925 - DNA, 1569 bp, Veillonella sp. T34266-5
  ref <308>: DATABASE ACCESSION NUMBER: NCBI ACCESSION: NZ_PPCZ01000018.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaatctcggcatcgggactggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaatggttcttgtgcgaatagtgcgaggatttgacggtaccggaatagaaagccacggctaactacgtgccagcagccgcggtaatacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttatggtgggaactcatgagagactgccgcagacaatgcggaggaaggcggggatgacgtcaaatcatcatgccccttatgacctgggctacacacgtactacaatgggagttaatagacggaagcgaaaccgcgaggtggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9926 - DNA, 1568 bp, Veillonella sp. VA137
  ref <308>: DATABASE ACCESSION NUMBER: NCBI ACCESSION: NZ_RQVK01000027.1
  ref <309>: DATABASE ENTRY DATE: 2019-04-01
  ref <313>: RELEVANT RESIDUES IN SEQ ID NO: (1)..(1568)
ttggagagtttgatcctggctcaggacgaacgctggcggcgtgcttaacacatgcaagtcgaacggacagacagggagcttgctcccttgaagttagtggcgaacgggtgagtaacgcgtaatcaacctgcccttcagagggggataacaacgggaaaccgttgctaataccgcgtacgattcatgaacggcatcgtttatgaatgaaagatggcctctatttataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9927 - DNA, 1567 bp, Veillonella sp. VA139
  ref <308>: DATABASE ACCESSION NUMBER: NCBI ACCESSION: NZ_RQVL01000046.1
  ref <309>: DATABASE ENTRY DATE: 2019-04-01
  ref <313>: RELEVANT RESIDUES IN SEQ ID NO: (1)..(1567)
ttggagagtttgatcctggctcaggacgaacgctggcggcgtgcttaacacatgcaagtcgaacggacagacagagagcttgctctcttgaagttagtggcgaacgggtgagtaacgcgtaatcaacctgcccttcagagggggataacaacgggaaaccgttgctaataccgcgtacgattcacgagcggcatcgcttgtgaatgaaaggtggcctctatatataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgcgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9928 - DNA, 1567 bp, Veillonella sp. VA141
  ref <308>: DATABASE ACCESSION NUMBER: NCBI ACCESSION: NZ_RQVM01000008.1
  ref <309>: DATABASE ENTRY DATE: 2019-04-01
  ref <313>: RELEVANT RESIDUES IN SEQ ID NO: (1)..(1567)
ttggagagtttgatcctggctcaggacgaacgctggcggcgtgcttaacacatgcaagtcgaacggacagacagagagcttgctctcttgaagttagtggcgaacgggtgagtaacgcgtaatcaacctgcccttcagagggggataacaacgggaaaccgttgctaataccgcgtacgattcataagcggcatcgcttgtgaatgaaaggtggcctctatgtataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9929 - DNA, 1561 bp, Veillonella sp. VA142
  ref <308>: DATABASE ACCESSION NUMBER: NCBI ACCESSION: NZ_RQVN01000041.1
  ref <309>: DATABASE ENTRY DATE: 2019-04-01
  ref <313>: RELEVANT RESIDUES IN SEQ ID NO: (1)..(1561)
ttggagagtttgatcctggctcaggacgaacgctggcggcgtgcttaacacatgcaagtcgaacggacagacagggagcttgctctcttgaagttagtggcgaacgggtgagtaacgcgtaatcaacctgcccttcagagggggataacaacgggaaaccgttgctaataccgcgtacgattcatgaacggcatcgtttgtgaatgaaaggtggcctctatgtataagctatcgctgaaggaggggattgcgtctgattagctagttggaggggtaatggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtaaataatgcagaaaagtgacggtaccggaatagaaagccacggctaactacgtgccagcagccgcggtaatacgtaggtggcaagcgttgtccggaattattgggcgtaaagcgcgcgcaggcggcttatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttcta

SEQ ID NO: 9930 - DNA, 1570 bp, Veillonella sp. oral taxon 158
  ref <308>: DATABASE ACCESSION NUMBER: NCBI ACCESSION: NZ_AENU01000007.1
  ref <309>: DATABASE ENTRY DATE: 2019-04-01
  ref <313>: RELEVANT RESIDUES IN SEQ ID NO: (1)..(1570)
ttggagagtttgatcctggctcaggacgaacgctggcggcgtgcttaacacatgcaagtcgaacgaagagcgatggaagcttgcttctatcaatcttagtggcgaacgggtgagtaacgcgtaatcaacctgcccttcagagggggacaacagttggaaacgactgctaataccgcatacgatccaacctcggcatcgaggatggatgaaaggtggcctctatttataagctatcactgaaggaggggattgcgtctgattagctagttggaggggtaacggcccaccaaggcaatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggtcttcttgcgaatagttagaagaattgacggtaccggaatagaaagccacggctaactacgtgccagcagccgcggtaatacgtaggtggcaagcgttgtccggaattattgggcgtaaagcgcgcgcaggcggatcagttagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacgtaatggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9931 - DNA, 1568 bp, Veillonella sp. oral taxon 780
  ref <308>: DATABASE ACCESSION NUMBER: NCBI ACCESSION: NZ_AFUJ01000050.1
  ref <309>: DATABASE ENTRY DATE: 2019-04-01
  ref <313>: RELEVANT RESIDUES IN SEQ ID NO: (1)..(1568)
ttggagagtttgatcctggctcaggacgaacgctggcggcgtgcttaacacatgcaagtcgaacggacagacagagagcttgctctcttgaagttagtggcgaacgggtgagtaacgcgtaatcaacctgcccttcagagggggataacaacgggaaaccgttgctaataccgcgtacgattcacaggcggcatcgcttgtgaatgaaaggtggcctctatatataagctatcgctgaaggaggggattgcgtctgattagctagttggaggggtaacggcccaccaaggcaatgatcagtagccggtctgagaggatgaacggccacattgggactgagacacggcccaaactcctacgggaggcagcagtggggaatcttccgcaatggacgaaagtctgacggagcaacgccgcgtgagtgatgaaggtcttcggattgtaaagctctgttaatcgggacgaaagagttctgtgtgaataatgcagaaaagtgacggtaccggaatagaaagccacggctaactacgtgccagcagccgcggtaatacgtaggtggcaagcgttgtccggaattattgggcgtaaagcgcgcgcaggcggcctatccagtctgtcttaaaagttcggggctcaaccccgtgatgggatggaaactagtaggctagagtatcggagaggaaagcggaattcctagtgtagcggtgaaatgcgtagatattaggaagaacaccagtggcgaaggcggctttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacggtcgcaaggctgaaactcaaaggaattgacgggggcccgcacaagcggtggagtatgtggtttaattcgacgcaacgcgaagaaccttaccaggtcttgacattgatggacgaaacaagagattgtttttctccttcgggagccagaaaacaggtggtgcacggctgtcgtcagctcgtgtcgtgagatgttgggttaagtcccgcaacgagcgcaacccctatcttatgttgccagcacgtaaaggtgggaactcatgagagactgccgcagacaatgcggaggaaggcggggatgacgtcaagtcatcatgccccttatgacctgggctacacacgtactacaatgggctttaatagagggaagcgaagccgcgaggtggagcaaaccccagaaacaagctctcagttcggatcgtaggctgcaactcgcctacgtgaagtcggaatcgctagtaatcgcaggtcagcatactgcggtgaatacgttcccgggccttgtacacaccgcccgtcacaccacgaaagtcggaagtacccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9932 - DNA, 1569 bp, Veillonella tobetsuensis
  ref <308>: DATABASE ACCESSION NUMBER: NCBI ACCESSION: NZ_PPDF01000008.1
  ref <309>: DATABASE ENTRY DATE: 2019-04-01
  ref <313>: RELEVANT RESIDUES IN SEQ ID NO: (1)..(1569)
ttggagagtttgatcctggctcaggacgaacgctggcggcgtgcttaacacatgcaagtcgaacgaagagacttggaagcttgcttctaagaatcttagtggcgaacgggtgagtaacgcgtaatcaacctgcccttcagagggggacaacagttggaaacgactgctaataccgcatacgatccaatctcggcatcgaggatggatgaaaggtggcctctatttataagctatcactgaaggaggggattgcgtctgattagctagttggaggggtaacggcccaccaaggcgatgatcagtagccggtctgagaggatgaacggccacattgggactgagacacggcccagactcctacgggaggcagcagtggggaatcttccgcaatggacgaaagtctgacggagcaacgccgcgtgagtgatgacggccttcgggttgtaaagctctgttaatcgggacgaaaggccttcttgcgaatagttagaaggattgacggtaccggaatagaaagccacggctaactacgtgccagcagccgcggtaatacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacgggattagataccccggtagtcctggccgtaaacgatgggtactaggtgtaggaggtatcgaccccttctgtgccggagttaacgcaataagtaccccgcctggggagtacgaccgcaaggttgaaactcaaaggaattgacgggggcccgcacaagcggtggagtatgtggtttaattcgacgcaacgcgaagaaccttaccaggtcttgacattgatggacagaactagagatagttcctcttcttcggaagccagaaaacaggtggtgcacggttgtcgtcagctcgtgtcgtgagatgttgggttaagtcccgcaacgagcgcaacccctatcttatgttgccagcacttcgggtgggaactcatgagagactgccgcagacaatgcggaggaaggcggggatgacgtcaaatcatcatgccccttatgacctgggctacacacgtactacaatgggagttaatagacggaagcgagatcgcgagatggagcaaacccgagaaacactctctcagttcggatcgtaggctgcaattcgcctacgtgaagtcggaatcgctagtaatcgcaggtcagcatactgcggtgaatacgttcccgggccttgtacacaccgcccgtcacaccacgaaagtcggaagtgcccaaagccggtggggtaaccttcgggagccagccgtctaaggtaaagtcgatgattggggtgaagtcgtaacaaggtagccgtatcggaaggtgcggctggatcacctcctttctagggaga

SEQ ID NO: 9933 - DNA, 1580 bp, Veillonellaceae bacterium DNF00626
  ref <308>: DATABASE ACCESSION NUMBER: NCBI ACCESSION: NZ_KQ960846.1
  ref <309>: DATABASE ENTRY DATE: 2019-04-01
  ref <313>: RELEVANT RESIDUES IN SEQ ID NO: (1)..(1580)
ctatcatggagagtttgatcctggctcaggacgaacgctggcggcgtgcttaacacatgcaagtcgaacgggaagacatgaagagcttgctctttatgaaatccagtggcaaacgggtgagtaacacgtaaacaacctgccttcaggatggggacaacagacggaaacgactgctaataccgaatacgattcttgagtcgcatgacacaagaaagaaagggtggcctctacttgtaagctatcgcctgaagaggggtttgcgtccgattaggtagttggtgaggtaacggcccaccaagccgacgatcggtagccggtctgagaggatgaacggccacattggaactgagacacggtccagactcctacgggaggcagcagtggggaatcttccgcaatgggcgaaagcctgacggagcaacgccgcgtgagtgaagacggccttcgggttgtaaaactctgtgattcgggacgaaagataagtagacgaataatctgcataagtgacggtaccgaaaaagcaagccacggctaactacgtgccagcagccgcggtaatacgtaggtggcaagcgttgtccggaattattgggcgtaaagcgcgcgcaggcggctacttaagtccatcttaaaagtgcggggcttaaccccgtgatgggatggaaactgagaagctggagtgtcggagaggaaagtggaattcctagtgtagcggtgaaatgcgtagagattaggaagaacaccggtggcgaaggcgactttctggacgacaactgacgcttaggcgcgaaagcgtggggagcaaacaggattagataccctggtagtccacgccgtaaacgatggatactaggtgtaggaggtatcgaccccttctgtgccggagttaacgcaataagtatcccgcctgggaagtacgatcgcaagattaaaactcaaaggaattgacgggggcccgcacaagcggtggagtatgtggtttaattcgacgcaacgcgaagaaccttaccaggtcttgacattgatcgctattttcagaaatgagaagttctccttcgggagacgagaaaacaggtggtgcacggctgtcgtcagctcgtgtcgtgagatgttgggttaagtcccgcaacgagcgcaacccctatcatttgttgccagcacgcaaaggtgggaactcaaatgagaccgccgcagacaatgcggaggaaggcggggacgacgtcaagtcatcatgccccttatgacctgggctacacacgtactacaatgggtgtcaacaaagagaagcgaaggagcgatccggagcaaacctcaaaaacacacccccagttcagatcgcaggctgcaactcgcctgcgtgaagcaggaatcgctagtaatcgcgggtcagcataccgcggtgaatacgttcccgggccttgtacacaccgcccgtcacactatgagagtcggaaacacccgaagccggtgaggtaaccgcaaggagccagccgtcgaaggtggagctgatgattggagtgaagtcgtaacaaggtagccgtatcggaaggtgcggctggatcacctcctttctaaggaga

SEQ ID NO: 9934 - DNA, 1572 bp, Veillonellaceae bacterium DNF00751
  ref <308>: DATABASE ACCESSION NUMBER: NCBI ACCESSION: NZ_KQ960889.1
  ref <309>: DATABASE ENTRY DATE: 2019-04-01
  ref <313>: RELEVANT RESIDUES IN SEQ ID NO: (1)..(1572)
tatcatggagagtttgatcctggctcaggacgaacgctggcggcgtgcttaacacatgcaagtcgaacgagaggacatgggaagcttgcttcctatgaaatcgagtggcaaacgggtgagtaacgcgtaaacaacctgcccttcggatggggataacagccggaaacggctgctaataccgaatacgatcttttcgtcgcatgacggaaagaagaaaggatggcctctatacaaagctatcgccgaaggaggggtttgcgtctgattagctggttggaggggtaacggcccaacaaggcgatgatcagtagccggtctgagaggatgaacggccacattgggactgagacacggcccagactcctacgggaggcagcagtggggaatcttccgcaatggacgaaagtctgacggagcaacgccgcgtgagtgaagaaggtcttcggattgtaaaactctgttatacgggacgaaaaagacggatgccaacagtatccgtccgtgacggtaccgtaagagaaagccacggctaactacgtgccagcagccgcggtaatacgtaggtggcaagcgttgtccggaattattgggcgtaaagggcgcgcaggcggttcggtaagtctgtcttaaaagtgcggggcttaaccccgtgaggggacggaaactgtcgaacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacaggattagataccctggtagtccacgccgtaaacgatggatactaggtgtaggaggtatcgaccccttctgtgccgtagttaacgctataagtatcccgcctggggagtacggccgcaaggttgaaactcaaaggaattgacgggggcccgcacaagcggtggagtatgtggtttaattcgacgcaacgcgaagaaccttaccaagccttgacattgatcgcaattttcagagatgagaagttcctcttcggaggacgagaaaacaggtggtgcacggctgtcgtcagctcgtgtcgtgagatgttgggttaagtcccgcaacgagcgcaacccctatcttctgttaccagcacgtaagggtggggactcaggagagactgccgcagacaatgcggaggaaggcggggatgacgtcaagtcatcatgccccttatggcttgggctacacacgtactacaatggctctaaatagagggaagcgaaggagcgatccggagcaaaacccaaaaacagagtcccagttcggattgcaggctgcaactcgcctgcatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtgggggcgatgattggggtgaagtcgtaacaaggtagccgtatcggaaggtgcggctggatcacctcctttcta

SEQ ID NO: 9935 - DNA, 1572 bp, Veillonellaceae bacterium KA00182
  ref <308>: DATABASE ACCESSION NUMBER: NCBI ACCESSION: NZ_KQ960935.1
  ref <309>: DATABASE ENTRY DATE: 2019-04-01
  ref <313>: RELEVANT RESIDUES IN SEQ ID NO: (1)..(1572)
atggagagtttgatcctggctcaggacgaacgctggcggcgtgcttaacacatgcaagtcgaacgagaggatatggaaagcttgctttctataaaatctagtggcaaacgggtgagtaacgcgtaaacaacctgcccttcggatggggacaacagctggaaacggctgctaataccgaatacgttcttttcatcgcatggtgagaagaagaaaggacggcctctacacaaagcggtcgccgaaggaggggtttgcgtctgattagctagttggaggggtaacggcccaacaaggcgacgatcagtagccggtctgagaggatgaacggccacattgggactgagacacggcccagactcctacgggaggcagcagtggggaatcttccgcaatggacgaaagtctgacggagcaacgccgcgtgagtgaagacggtcttcggattgtaaagctctgttatacgggacgaacggcaaggtggtaaatagccatcatgagtgacggtaccgtaagagaaagccacggctaactacgtgccagcagccgcggtaatacgtaggtggcaagcgttgtccggaattattgggcgtaaagggcgcgcaggcggttttttaagtcggtcttaaaagtgcggggcttaaccccgtgaggggaccgaaactggaagacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacaggattagataccctggtagtccacgccgtaaacgatggatactaggtgtaggaggtatcgactccttctgtgccgtagttaacgctataagtatcccgcctggggagtacggccgcaaggttgaaactcaaaggaattgacgggggcccgcacaagcggtggagtatgtggtttaattcgacgcaacgcgaagaaccttaccaagccttgacattgatcgcaattttcagagatgagaagttcctcttcggaggacgagaaaacaggtggtgcacggctgtcgtcagctcgtgtcgtgagatgttgggttaagtcccgcaacgagcgcaacccctatcttctgttaccagcacgtaaaggtggggactcaggagagactgccgcagacaatgcggaggaaggcggggatgacgtcaagtcatcatgccccttatggcttgggctacacacgtactacaatggctcttaatagagggaagcgaaggagtgatctggagcaaaccccaaaaacagagtctcagttcggattgtaggctgcaactcgcctacatgaagcaggaatcgctagtaatcgcaggtcagcatactgcggtgaatacgttcccgggccttgtacacaccgcccgtcacaccacgaaagtcattcacacccgaagccggtgaggtaaccgcaaggagccagccgtcgaaggtaggggtgatgattggggtgaagtcgtaacaaggtagccgtatcggaaggtgcggctggatcacctcctttctaggga

SEQ ID NO: 9936 - DNA, 273 bp, Verrucomicrobia bacterium
  ref <308>: DATABASE ACCESSION NUMBER: NCBI ACCESSION: NZ_OKRK01000369.1
  ref <309>: DATABASE ENTRY DATE: 2019-04-01
  ref <313>: RELEVANT RESIDUES IN SEQ ID NO: (1)..(273)
agagtttgattctggctcagaacgaacgctggcggcgtggataagacatgcaagtcgagcgctaattacggggtagcaatattccgtggttggagcggcgcaagggtgcgtaacacgtgggtaatctgccgtgaagtttgggataactcgctgaaaggcgagctaataccggatgtgaagattggaaggcatcttttgattttcaaagctggggaccgtaaggcctggcgcttcatgatgagcccgcggcctatcagctagttggtaaggtaa

SEQ ID NO: 9937 - DNA, 1561 bp, Verrucomicrobia bacterium IMCC26134
  ref <308>: DATABASE ACCESSION NUMBER: NCBI ACCESSION: NZ_CP011265.1
  ref <309>: DATABASE ENTRY DATE: 2019-04-01
  ref <313>: RELEVANT RESIDUES IN SEQ ID NO: (1)..(1561)
ttttcggagagtttgatcctggctcagaatgaacgctggcggcgtggttaagacatgcaagtcgaacggtgttttggtagtagcaatactattgaaacgcagtggcgaacgggtgcgtaacacgtgaacaatttacctccgagtggggaatagctcgccgaaaggcgaattaataccgcatatgattgatgtccgcctggatgtcatattaaagccggggaccgcaaggcccggcgctaggagaggagttcgcggcctatcagctagttggtgaggtaacggcccaccaaggctaagacgggtagccggtctgagaggatgatcggccacactggaactgagacacggtccagacacctacgggtggcagcagtttcgaatcattcacaatgggcgaaagcctgatggtgcgacgccgcgtgagggatgaaggtcttcggattgtaaacctctgtcactagggaagaaacgttgaatcctaatacgattcagcctgacttaacctggagaggaagcagtggctaactctgtgccagcagccgcggtaatacagagactgcaagcgttattcggattcactgggcgtaaagggtgcgcaggcggccatgtgtgtcagatgtgaaatcccggggcttaaccccggaactgcgtctgaaactacatggctagagcattggagagggaagtggaattcatggtgtagcagtgaaatgcgtagatatcatgaggaacaccagaggcgaaggcgacttcctggacaattgctgacgctcaggcacgaaagcgtgggtagcaaaagggattagatacccctgtagtccacgccctaaacggtgcatactaggtcttggcggattcgaccccgtcagggcccaagctaacgcgttaagtatgccgcctgaggactacggccgcaaggctaaaactcaaaggaattgacgggggcccgcacaagcggtggagtatgtggcttaattcgatgcaacgcgaagaaccttaccaggccttgacatgcaattgatcgcacctgaaagggtgctttccttcgggacagttgcacaggtgctgcatggctgtcgtcagctcgtgtcgtgagatgttgcgttaagtcgcgcaacgagcgcaacccctgtccttagttgccatcattaagttgggcactctagggagacaaaccctctttgagggtgggaaggtggggatgacgtcaagtcaggatggcccttacggcctgggctgcacacgtactacaatgctcggtacagagggaagcaataccgcgaggtggagccaatcctcaaaaccgagcccagttcggattgtagtctgcaactcgactacatgaagttggaatcgctagtaatggcgcatcagctacggcgccgtgaatacgttcccgggccttgtacacaccgcccgtcacatcatgaaagccggtttcgcccgaagtgcgtttgccaacccgtaagggaggcgacgtcctaaggtgaggctggtgattgggatgaagtcgtaacaaggtaaccgtaggggaacctgcggttggatcacctcctttcta

SEQ ID NO: 9938 - DNA, 1549 bp, Verrucomicrobia bacterium LP2A
  ref <308>: DATABASE ACCESSION NUMBER: NCBI ACCESSION: NZ_JAFS01000001.1
  ref <309>: DATABASE ENTRY DATE: 2019-04-01
  ref <313>: RELEVANT RESIDUES IN SEQ ID NO: (1)..(1549)
atcacggagagtttgattctggctcagagcgaacgctggcggcgtggataagacatgcaagtcgcacgaagcttgtcttctagcaataggaggcaagttcagtggcgaacgggtgagtaacgcgtgggaatctactcagaagtggggaatagcccggcgaaagccggggtaattccgcatgtggtctagcctagctagattaaagcgggggacccgaaagggcctcgcgcttctgaatgagcccgcgtcctatcagctagttggtggggtaaaagcccaccaaggcgatgacgggtagctggtctgagaggatggccagccacactgggactgagacacggcccagacacctacgggtggcagcagtcgagaatttttcacaatgggcgaaagcctgatggagcgacgccgcgtggaggaggaaggccttcgggttgtaaactcctgtcactgcagaacaaggttcccctgccgaataagcaggaggacttgatagtatgcggagaggaagggacggctaactctgtgccagcagccgcggtaatacagaggtcccgagcgttgctcggatttactgggcgtaaagggtgtgtaggaggttaggaaagtcgaatgtgaaatccctctgcctaacggaggaactgcgttcgaaactgcctggctagaggttcggatggggaagcggaactctcggtgtagcagtgaaatgcgtagatatcgagaggaacaccggtggcgaaggcggcttcctggacgaaacctgactctgaaacacgaaagctaggggagcgaacgggattagataccccggtagtcctagccgtaaacggtgtgcgttaggtgttggcggattcgaccccgccggtgccgaagctaacgcagtaaacgcaccgcctgaggagtacggtcgcaaggctaaaactcaaagaaattgacgggggcccgcacaagcggtggagcatgtggcttaattcgatgcaacgcgaagaaccttacctggccttgacatgcagcgttcagtcccggaaacgggatggcccgcaagggcgagctgcacaggtgctgcatggctgtcgtcagctcgtgtcgtgagatgttgggttaagtcccccaacgagcgcaacccctgtgtcttgttgccgaaaggctctctggacagactgcccccttcaagggggaggaaggtggggacgacgtcaagtcaggatggcccttatggccagggctgcacacgtgctacaatgctcggtacaaagggacgcaagaccgtgaggtgtagcaaatccccaaaaccgagcccagttcagattgaaggctgcaactcgccttcatgaagccggaatcgctagtaatggcgcatcagctacggcgccgtgaatacgttcccgggccttgtacacaccgcccgtcacatcctgaaagttggctgcacccgaagccgttcttttgagcgtcgaaggtgtgactagtgattgggatgaagtcgtaacaaggtagccgtaggggaacctgcggctggatcacctcctttctaaggagtaggtccggg

SEQ ID NO: 9939 - DNA, 1549 bp, Verrucomicrobium sp. 3C
  ref <308>: DATABASE ACCESSION NUMBER: NCBI ACCESSION: NZ_KB901875.1
  ref <309>: DATABASE ENTRY DATE: 2019-04-01
  ref <313>: RELEVANT RESIDUES IN SEQ ID NO: (1)..(1549)
attacggagagtttgattctggctcagagcgaacgctggcggcgtggataagacatgcaagtcgcacgcagcttgtttcctagcaataggaggcgagttcagtggcgaacgggtgagtaacgcgtgggaatctactccaaagtggggaatagcccggcgaaagccggggtaattccgcatgtggtctagcctagctagattaaagcgggggactcgaaagggcctcgcgcttcggaatgagcccgcgtcctatcagctagttggcggggtaaatgcccaccaaggcgatgacgggtagctggtctgagaggatggccagccacactgggactgagacacggcccagacacctacgggtggcagcagtcgagaatttttcacaatgggcgaaagcctgatggagcgacgccgcgtggaggaggaaggccttcgggttgtaaactcctgtcaccgcagaacaaggttcgcctgccgaataagcgggaggacttgatagtatgtggagaggaagggacggctaactctgtgccagcagccgcggtaatacagaggtcccgagcgttgctcggatttactgggcgtaaagggtgtgtaggaggttgggaaagtcgaatgtgaaatccctctgcctaacggaggaactgcgttcgaaactacccggctagaggttcggatggggaagcggaactctcggtgtagcagtgaaatgcgtagatatcgagaggaacaccggtggcgaaggcggcttcctggacgaaacctgactctgaaacacgaaagctaggggagcaaacgggattagataccccggtagtcctagccgtaaacggtgtgcgttaggtgttggcggattcgaccccgccggtgccgaagctaacgcattaaacgcaccgcctgaggagtacggtcgcaaggctaaaactcaaagaaattgacgggggcccgcacaagcggtggagcatgtggcttaattcgatgcaacgcgaagaaccttacctggccttgacatgcagcgttcagtcccggaaacgggatggcccgcaagggcgagctgcacaggtgctgcatggctgtcgtcagctcgtgtcgtgagatgttgggttaagtcccccaacgagcgcaacccctgtgtctagttgccgaaaggctctctagacagactgccctcttcaagggggaggaaggtggggacgacgtcaagtcaggatggcccttatggccagggctgcacacgtgctacaatgctcggtacaaagggacgcaagaccgcgaggtgtagcaaatccccaaaaccgagcccagttcagattgaaggctgcaactcgccttcatgaagccggaatcgctagtaatggcgcatcagctacggcgccgtgaatacgttcccgggccttgtacacaccgcccgtcacatcctgaaagctggctgtacccgaagccgttctcttgagcgtcgaaggtgtggctagtgattgggatgaagtcgtaacaaggtagccgtaggggaacctgcggctggatcacctcctttctaaggagtaggttcggg

SEQ ID NO: 9940 - DNA, 1524 bp, Verrucosispora sp. FIM060022
  ref <308>: DATABASE ACCESSION NUMBER: NCBI ACCESSION: NZ_RQIV01000024.1
  ref <309>: DATABASE ENTRY DATE: 2019-04-01
  ref <313>: RELEVANT RESIDUES IN SEQ ID NO: (1)..(1524)
tgttggagagtttgatcctggctcaggacgaacgctggcggcgtgcttaacacatgcaagtcgagcggaaaggcccttcggggtactcgagcggcgaacgggtgagtaacacgtgagcaacctgccctaggctttgggataaccctcggaaacgggggctaataccgaatattcactcacgggcgcatgtttgtgggtggaaagtttttcggcttgggatgggctcgcggcctatcagcttgttggtggggtaatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgcaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgtggctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatcgccggaaatcctgcagagatgtggggtccttcggggccggtgacaggtggtgcatggctgtcgtcagctcgtgtcgtgagatgttgggttaagtcccgcaacgagcgcaaccctcgtcccatgttgccagcaattcggttggggactcatgggagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttgtggagggagccgtcgaaggtggggctggcgattgggacgaagtcgtaacaaggtagccgtaccggaaggtgcggctggatcacctcctttctaaggagca

SEQ ID NO: 9941 - DNA, 1526 bp, Verrucosispora sp. LHW63014
  ref <308>: DATABASE ACCESSION NUMBER: NCBI ACCESSION: NZ_QVFU01000101.1
  ref <309>: DATABASE ENTRY DATE: 2019-04-01
  ref <313>: RELEVANT RESIDUES IN SEQ ID NO: (1)..(1526)
tgttggagagtttgatcctggctcaggacgaacgctggcggcgtgcttaacacatgcaagtcgagcggaaaggcccttcggggtactcgagcggcgaacgggtgagtaacacgtgagcaacctgccctaggctttgggataaccctcggaaacgggggctaataccgaatattcactcatgggcgcatgtttgtgggtggaaagtttttcggcttgggatgggctcgcggcctatcagcttgttggtggggtgatggcctaccaaggcgacgacgggtagccggcctgagagggcgaccggccacactgggactgagacacggcccagactcctacgggaggcagcagtggggaatattgcacaatgggcggaagcctgatgcagcgacgccgcgtgagggatgacggccttcgggttgtaaacctctttcagcagggacgaagcgtaagtgacggtacctgcagaagaagcgccggccaactacgtgccagcagccgcggtaagacgtagggcgcgagcgttgtccggatttattgggcgtaaagagctcgtaggcggcttgtcgcgtcgactgtgaaaacccgtggctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacaggattagataccctggtagtccacgctgtaaacgttgggcgctaggtgtggggggcctctccggttctctgtgccgcagctaacgcattaagcgccccgcctggggagtacggccgcaaggctaaaactcaaaggaattgacgggggcccgcacaagcggcggagcatgcggattaattcgatgcaacgcgaagaaccttacctgggtttgacatcgccggaaatcctgcagagatgtggggtccttcggggccggtgacaggtggtgcatggctgtcgtcagctcgtgtcgtgagatgttgggttaagtcccgcaacgagcgcaaccctcgttcgatgttgccagcgcgttatggcggggactcatcgaagactgccggggtcaactcggaggaaggtggggatgacgtcaagtcatcatgccccttatgtccagggcttcacgcatgctacaatggccggtacaatgggctgcgataccgtgaggtggagcgaatcccaaaaagccggtctcagttcggatcggggtctgcaactcgaccccgtgaagtcggagtcgctagtaatcgcagatcagcaacgctgcggtgaatacgttcccgggccttgtacacaccgcccgtcacgtcacgaaagtcggcaacacccgaagccggtggcccaacccttttgggagggagccgtcgaaggtggggctggcgattgggacgaagtcgtaacaaggtagccgtaccggaaggtgcggctggatcacctcctttctaaggagca

SEQ ID NO: 9942 - DNA, 1553 bp, Vibrio albensis
  ref <308>: DATABASE ACCESSION NUMBER: NCBI ACCESSION: NZ_LOSL02000001.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggcagcacagaggaacttgttccttgggtggcgagcggcggacgggtgagtaatgcctgggaaattgcccggtagagggggataaccattggaaacgatggctaataccgcataacctcgcaagagcaaagcaggggaccttcgggccttgcgctatcggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtggttaagttaataccttaatcatttgacgttacctacagaagaagcaccggctaactccgtgccagcagccgcggtaatacggagggtgcaagcgttaatcggaattactgggcgtaaagcgcatgcaggtggtttgttaagtcagatgtgaaagccctgggctcaacctaggaatcgcatttgaaactgacaagctagagtactgtagaggggggtggaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtgccctagaggtgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatctagcggagacgctggagtgccttcgggagctctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggcagcgataccgcgaggtggagcgaatctcacaaagtacgtcgtagtccggattggagtctgcaactcgactccatgaagtcggaatcgctagtaatcgcaaatcagaatgttgcggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctccttacacgaagat

SEQ ID NO: 9943 - DNA, 1562 bp, Vibrio alfacsensis
  ref <308>: DATABASE ACCESSION NUMBER: NCBI ACCESSION: NZ_CP032093.1
  ref <309>: DATABASE ENTRY DATE: 2019-04-01
  ref <313>: RELEVANT RESIDUES IN SEQ ID NO: (1)..(1562)
aaattgaagagtttgatcatggctcagattgaacgctggcggcaggcctaacacatgcaagtcgagcggcagcgacaacattgaatcttcggaggatttgttgggcggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaagcgcctgggttgtaaagcactttcagtagggaggaagcgttcatgcgttaatagcgtatggatttgacgttacctacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaattgcatttgaaactggcagactagagtactgtagaggggggtagaatttcaggtgtagcggtgaaatgcgtagagatctgaaggaataccggtggcgaagcgcggcccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagtagagatacaggtgtgccttctgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgaaagtgagcgaatcccaaaaagtgcgtcgtagtccggattggagtctgcaactcgactccatgaagtcggaatcgctagtaatcgtggatcagaatgccacggtgaatacgttcccggccttgtacacaccgcccgtcacaccatgggagtgggctgcaaagaagtaggtagtttaacctttcgggaggacgcttaccactttgtggttcatgactggggtgaagtcgtaacaaggtagcgctaggggaacctggcgctggatcacctccttatacgatgat

SEQ ID NO: 9944 - DNA, 1562 bp, Vibrio alginolyticus
  ref <308>: DATABASE ACCESSION NUMBER: NCBI ACCESSION: NZ_UHIJ01000002.1
  ref <309>: DATABASE ENTRY DATE: 2019-04-01
  ref <313>: RELEVANT RESIDUES IN SEQ ID NO: (1)..(1562)
aaattgaagagtttgatcatggctcagattgaacgctggcggcaggcctaacacatgcaagtcgagcggaaacgagttatctgaaccttcggggaacgataacggcgtcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagtcgtgaggaaggtggtagtgttaatagcactatcatttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaatagcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgagagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtaggtagtttaaccttcggggggacgcttaccactttgtggttcatgactggggtgaagtcgtaacaaggtagcgctaggggaacctggcgctggatcacctccttaaacgatgat

SEQ ID NO: 9945 - DNA, 1551 bp, Vibrio algivorus
  ref <308>: DATABASE ACCESSION NUMBER: NCBI ACCESSION: NZ_AP018678.1
  ref <309>: DATABASE ENTRY DATE: 2019-04-01
  ref <313>: RELEVANT RESIDUES IN SEQ ID NO: (1)..(1551)
ttaattgaagagtttgatcatggctcagattgaacgctggcggcaggcctaacacatgcaagtcgagcggaaacgagaatagcttgctattcggcgtcgagcggcggacgggtgagtaatgcataggaagttgcccagtagagggggataaccattggaaacgatggctaataccgcataacctcttcggagcaaagcgggggaccttcgggcctcgcgctactggatacgcctatgtgggattagctagttggtgaggtaaaggctcaccaaggcgacgatccctagctggtctgagaggatgatcagccacactgggactgagacacggcccagactcctacgggaggcagcagtggggaatattgcacaatgggcgaaagcctgatgcagccatgccgcgtgtatgaagaaggccttcgggttgtaaagtactttcagttgtgaggaaggtttcgtagttaataactgcgttgcttgacgttagcaacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaaggtcatttgaaactggcaaactagagtactgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcgaacttgcgaaagtaagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtaggtagtttaaccttcgggaggacgcttaccactttgtggttcatgactggggtgaagtcgtaacaaggtagccctaggggaacctggggctggatcacctccttatacgaagat

SEQ ID NO: 9946 - DNA, 1555 bp, Vibrio anguillarum
  ref <308>: DATABASE ACCESSION NUMBER: NCBI ACCESSION: NZ_UGPJ01000001.1
  ref <309>: DATABASE ENTRY DATE: 2019-04-01
  ref <313>: RELEVANT RESIDUES IN SEQ ID NO: (1)..(1555)
ttaattgaagagtttgatcatggctcagattgaacgctggcggcaggcctaacacatgcaagtcgagcggcagcacagaggaacttgttccttgggtggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaaggtggtgttgttaatagcagcatcatttgacgttagcgacagaagaagcaccggctaactccgtgccagcagccgcggtaatacggagggtgcgagcgttaatcggaattactgggcgtaaagcgcatgcaggtggtggattaagtcagatgtgaaagcccggggctcaacctcggaaccgcatttgaaactggttcactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatctacagaatcctgcggagacgcgggagtgccttcgggaactgtaagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaacctttcgaggaggacgctcaccactttgtggttcatgactggggtgaagtcgtaacaaggtagcgctaggggaacctggcgctggatcacctccttatacgaagat

SEQ ID NO: 9947 - DNA, 1052 bp, Vibrio antiquarius
  ref <308>: DATABASE ACCESSION NUMBER: NCBI ACCESSION: NZ_AOJB01000014.1
  ref <309>: DATABASE ENTRY DATE: 2019-04-01
  ref <313>: RELEVANT RESIDUES IN SEQ ID NO: (1)..(1052)
cagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaatagcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgaaagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtaggtagtttaaccttcggggggacgcttaccactttgtggttcatgactggggtgaagtcgtaacaaggtagcgctaggggaacctggcgctggatcacctcctta

SEQ ID NO: 9948 - DNA, 1562 bp, Vibrio campbellii
  ref <308>: DATABASE ACCESSION NUMBER: NCBI ACCESSION: NZ_CP033134.1
  ref <309>: DATABASE ENTRY DATE: 2019-04-01
  ref <313>: RELEVANT RESIDUES IN SEQ ID NO: (1)..(1562)
aaattgaagagtttgatcatggctcagattgaacgctggcggcaggcctaacacatgcaagtcgagcggaaacgagttatctgaaccttcggggaacgataacggcgtcgagcggcggacgggtgagtaatgcctaggaaattgccctgatgtgggggataaccattggaaacgatggctaataccgcataacgcctacgggccaaagagggggaccttcgggcctctcgcgtcaggatatgcctaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagtcgtgaggaaggtagtgtagttaatagctgcattatttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaattgcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagccaacttgcgagagtgagcgaatcccaaaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggctgcaaaagaagtaggtagtttaaccttcgggaggacgcttaccactttgtggttcatgactggggtgaagtcgtaacaaggtagcgctaggggaacctggcgctggatcacctccttatacgatgat

SEQ ID NO: 9949 - DNA, 1565 bp, Vibrio chagasii
  ref <308>: DATABASE ACCESSION NUMBER: NCBI ACCESSION: NZ_CP034970.1
  ref <309>: DATABASE ENTRY DATE: 2019-04-01
  ref <313>: RELEVANT RESIDUES IN SEQ ID NO: (1)..(1565)
aaattgaagagtttgatcatggctcagattgaacgctggcggcaggcctaacacatgcaagtcgagcggaaacgagttatctgaaccttcggggaacgataacggcgtcgagcggcggacgggtgagtaatgcctaggaaattgccttgatgtgggggataaccattggaaacgatggctaataccgcataatgcctacgggccaaagagggggaccttcgggcctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagttgtgaggaagggggtgtcgttaatagcggcatctcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtactgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggagctctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggctgcaaacttgcgagagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagccctaggggaacctggggctggatcacctccttatacgaagata

SEQ ID NO: 9950 - DNA, 1549 bp, Vibrio cholerae
  ref <308>: DATABASE ACCESSION NUMBER: NCBI ACCESSION: NZ_UWOY01000015.1
  ref <309>: DATABASE ENTRY DATE: 2019-04-01
  ref <313>: RELEVANT RESIDUES IN SEQ ID NO: (1)..(1549)
ttaattgaagagtttgatcatggctcagattgaacgctggcggcaggcctaacacatgcaagtcgagcggcagcacagaggaacttgttccttgggtggcgagcggcggacgggtgagtaatgcctgggaaattgcccggtagagggggataaccattggaaacgatggctaataccgcataacctcgcaagagcaaagcaggggaccttcgggccttgcgctaccggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtggttaagttaataccttaatcatttgacgttacctacagaagaagcaccggctaactccgtgccagcagccgcggtaatacggagggtgcaagcgttaatcggaattactgggcgtaaagcgcatgcaggtggtttgttaagtcagatgtgaaagccctgggctcaacctaggaatcgcatttgaaactgacaagctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtgccctagaggtgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatctagcggagacgctggagtgccttcgggagctctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggcagcgataccgcgaggtggagcgaatctcacaaagtacgtcgtagtccggattggagtctgcaactcgactccatgaagtcggaatcgctagtaatcgcaaatcagaatgttgcggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctccttacacga

SEQ ID NO: 9951 - DNA, 1562 bp, Vibrio coralliilyticus
  ref <308>: DATABASE ACCESSION NUMBER: NCBI ACCESSION: NZ_CP031472.1
  ref <309>: DATABASE ENTRY DATE: 2019-04-01
  ref <313>: RELEVANT RESIDUES IN SEQ ID NO: (1)..(1562)
aaattgaagagtttgatcatggctcagattgaacgctggcggcaggcctaacacatgcaagtcgagcggaaacgagttatctgaaccttcggggaacgataacggcgtcgagcggcggacgggtgagtaatgcctgggaaattgccctgatgtgggggataaccattggaaacgatggctaataccgcataatagcttcggctcaaagagggggaccttcgggcctctcgcgtcaggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagcagtgaggaaggggtgtacgttaatagcgtgcatctttgacgttagctgcagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaatagcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccatagaactttccagagatggattggtgccttcgggaactatgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgaaagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaaccttcggggggacgctcaccactttgtggttcatgactggggtgaagtcgtaacaaggtagcgctaggggaacctggcgctggatcacctccttatacgatgat

SEQ ID NO: 9952 - DNA, 1565 bp, Vibrio crassostreae
  ref <308>: DATABASE ACCESSION NUMBER: NCBI ACCESSION: NZ_RKQV01000006.1
  ref <309>: DATABASE ENTRY DATE: 2019-04-01
  ref <313>: RELEVANT RESIDUES IN SEQ ID NO: (1)..(1565)
aaattgaagagtttgatcatggctcagattgaacgctggcggcaggcctaacacatgcaagtcgagcggaaacgacactaacaatccttcgggtgcgttaatgggcgtcgagcggcggacgggtgagtaatgcctaggaaattgccttgatgtgggggataaccattggaaacgatggctaataccgcataatgcctacgggccaaagagggggaccttcgggcctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagttgtgaggaagggggtagcgttaatagcgctatctcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtactgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggagctctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagccctaggggaacctggggctggatcacctccttatacgaagata

SEQ ID NO: 9953 - DNA, 1455 bp, Vibrio diabolicus
  ref <308>: DATABASE ACCESSION NUMBER: NCBI ACCESSION: NZ_PKPZ01000023.1
  ref <309>: DATABASE ENTRY DATE: 2019-04-01
  ref <313>: RELEVANT RESIDUES IN SEQ ID NO: (1)..(1455)
aaattgaagagtttgatcatggctcagattgaacgctggcggcaggcctaacacatgcaagtcgagcggaaacgagttatctgaaccttcgggggacgataacggcgtcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagtcgtgaggaaggtagtgtagttaatagctgcattatttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaatagcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgagagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtaggtagtc

SEQ ID NO: 9954 - DNA, 1351 bp, Vibrio fujianensis
  ref <308>: DATABASE ACCESSION NUMBER: NCBI ACCESSION: NZ_NBUS01000002.1
  ref <309>: DATABASE ENTRY DATE: 2019-04-01
  ref <313>: RELEVANT RESIDUES IN SEQ ID NO: (1)..(1351)
gtcaaagagggggaccttcgggcctctcgcgtcaggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaaggggatatcgttaatagcggtatgctttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggagttgcatttgaaactggcaggctagagtactgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgcggccttgagctgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggagctctgagacaggtgctgcatggctgtcgtcagctcgtgttgtgaaatgttgggttaagtcccgcaacgagcgcaacccttatccttgtttgccagcacttcgggtgggaactccagggagactgccggtgataaaccggaggaaggtggggacgacgtcaagtcatcatggcccttacgagtagggctacacacgtgctacaatggcgcatacagagggcggcgagacagcgatgttaagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagcaggtagtttaaccttcggggggacgcttgccactttgtggttcatgactggggtgaagtcgtaacaaggtagcgctaggggaacctggcgctggatcacctcctta

SEQ ID NO: 9955 - DNA, 1456 bp, Vibrio maerlii
  ref <308>: DATABASE ACCESSION NUMBER: NCBI ACCESSION: NZ_QRHC01000027.1
  ref <309>: DATABASE ENTRY DATE: 2019-04-01
  ref <313>: RELEVANT RESIDUES IN SEQ ID NO: (1)..(1456)
ggcgtcgagcggcggacgggtgagtaatgcctgggaatatgccttgatgtgggggataaccattggaaacgatggctaataccgcataaygccttcgggccaaagagggggaccttcgggcctctcgcgtcaagattagcccaggtgggattagctagttggtgaggtaaaggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagcagtgaggaaggttcatacgttaatagcgtatggatttgacgttagctgcagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaactgcatttgaaactggcaggctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgaaagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtgggtagtttaaccttcgggaggacgctcaccactttgtggttcatgactggggtgaagtcgtaacaaggtagccctaggggaacctggggctggatcacctccttatacgaa

SEQ ID NO: 9956 - DNA, 1552 bp, Vibrio mangrovi
  ref <308>: DATABASE ACCESSION NUMBER: NCBI ACCESSION: NZ_FXXI01000024.1
  ref <309>: DATABASE ENTRY DATE: 2019-04-01
  ref <313>: RELEVANT RESIDUES IN SEQ ID NO: (1)..(1552)
tttaattgaagagtttgatcatggctcagattgaacgctggcggcaggcctaacacatgcaagtcgagcggaaacgagagaaagcttgctttctcggcgtcgagcggcggacgggtgagtaaagcctgggaaattgccctgatgtgggggataaccattggaaacgatggctaataccgcataatgtctacggaccaaagagggggaccttcgggcctctcgcgtcaggatatgcccaggtgggattagctagttggtgaggtaaaggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagcagtgaggaaggggatagttttaatagagctgttctttgacgttagctgcagaagaagcaccggctaactccgtgccagcagccgcggtaatacggagggtgcgagcgttaatcggaattactgggcgtaaagcgcatgcaggtggtctgttaagtcagatgtgaaagcccggggcttaacctcggagttgcatttgaaactggcaggctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtgacccagagtcgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccggaagagattctggtgtgccttcgggagctctgagacaggtgctgcatggctgtcgtcagctcgtgttgtgaaatgttgggttaagtcccgcaacgagcgcaacccttatccttgattgccagcggttaggccgggaacttcagggagactgccggtgataaaccggaggaaggtggggacgacgtcaagtcatcatggcccttacgagtagggctacacacgtgctacaatggcgtatacagagggcagctaactcgcgagagcatgcgaatcccaaaaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctccttacgtaaaga

SEQ ID NO: 9957 - DNA, 1568 bp, Vibrio metschnikovii
  ref <308>: DATABASE ACCESSION NUMBER: NCBI ACCESSION: NZ_UHIS01000004.1
  ref <309>: DATABASE ENTRY DATE: 2019-04-01
  ref <313>: RELEVANT RESIDUES IN SEQ ID NO: (1)..(1568)
aaattgaagagtttgatcatggctcagattgaacgctggcggcaggcctaacacatgcaagtcgagcggtaacaggaaggaagcttgctttctttgctgacgagcggcggacgggtgagtaatgcctgggaaattgccctgatgtgggggataaccattggaaacgatggctaataccgcatgatgcccttgtttataatgaacagggaccaaagagggggaccttcgggcctctcgcgtcaggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaagggggtatcgttaatagcggtattctttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggagttgcatttgaaactggcaggctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgctgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatctacaggatcctgcggagacgcgggagtgccttcgggaactgtaagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggcgagctagcgatagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctccttacgtaaaga

SEQ ID NO: 9958 - DNA, 1562 bp, Vibrio owensii
  ref <308>: DATABASE ACCESSION NUMBER: NCBI ACCESSION: NZ_CP033144.1
  ref <309>: DATABASE ENTRY DATE: 2019-04-01
  ref <313>: RELEVANT RESIDUES IN SEQ ID NO: (1)..(1562)
aaattgaagagtttgatcatggctcagattgaacgctggcggcaggcctaacacatgcaagtcgagcggaaacgagttatctgaaccttcggggaacgataacggcgtcgagcggcggacgggtgagtaatgcctaggaaattgccctgatgtgggggataaccattggaaacgatggctaataccgcataatgcctacgggccaaagagggggaccttcgggcctctcgcgtcaggatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagttgtgaggaaggtggtgtagttaatagctgcattacttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaatagcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtaggtagtttaaccttcgggaggacgcttaccactttgtggttcatgactggggtgaagtcgtaacaaggtagcgctaggggaacctggcgctggatcacctccttaaacgatgat

SEQ ID NO: 9959 - DNA, 710 bp, Vibrio palustris
  ref <308>: DATABASE ACCESSION NUMBER: NCBI ACCESSION: NZ_FUFT01000004.1
  ref <309>: DATABASE ENTRY DATE: 2019-04-01
  ref <313>: RELEVANT RESIDUES IN SEQ ID NO: (1)..(710)
actttaattgaagagtttgatcatggctcagattgaacgctggcggcaggcctaacacatgcaagtcgagcggtaacatttctagcttgctagaagatgacgagcggcggacgggtgagtaatgcctgggaaattgccttgatgtgggggataaccattggaaacgatggctaataccgcataacgccttcgggccaaagagggggaccttcgggcctctcgcgtcaagatatgcccaggtgagattagcttgttggtgaggtaagagctcaccaaggcgacgatctctagctggtctgagaggatgatcagccacattgggactgagacacggcccaaactcctacgggaggcagcagtggggaatattgcacaatgggcgcaagcctgatgcagccatgccgcgtgtatgaagaaggccttcgggttgtaaagtactttcagcagtgaggaaggggtaacgttgaataggcgttattcttgacgttagctgcagaagaagcaccggctaactccgtgccagcagccgcggtaatacggagggtgcgagcgttaatcggaattactgggcgtaaagcgcatgcaggtggtctgttaagtcagatgtgaaagcccgaggcttaacctcggaattgcatttgaaactggcaggctagagtactgtagaggggggtagaatttcaggtgtagcggtgaaatgcgtagagatc

SEQ ID NO: 9960 - DNA, 1081 bp, Vibrio pectenicida
  ref <308>: DATABASE ACCESSION NUMBER: NCBI ACCESSION: NZ_RSFA01000219.1
  ref <309>: DATABASE ENTRY DATE: 2019-04-01
  ref <313>: RELEVANT RESIDUES IN SEQ ID NO: (1)..(1081)
cattcatttgacgttagctgcagaagaagcaccggctaactccgtgccagcagccgcggtaatacggagggtgcgagcgttaatcggaattactgggcgtaaagcgcatgcaggtggatgattaagtcagatgtgaaagcccggggctcaacctcggaatagcatttgaaactggtcatctagagtactgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggagctctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcaaaagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtaggtagtttaaccttcgggagaacgcttaccactttgtggttcatgactggggtgaagtcgtaacaaggtagcgctaggggaacctggcgctggatcacctccttatacgatgat

SEQ ID NO: 9961 - DNA, 1093 bp, Vibrio penaeicida
  ref <308>: DATABASE ACCESSION NUMBER: NCBI ACCESSION: NZ_RXYX01000376.1
  ref <309>: DATABASE ENTRY DATE: 2019-04-01
  ref <313>: RELEVANT RESIDUES IN SEQ ID NO: (1)..(1093)
cggacgggtgagtaatgcctgggaaattgccctgatgtgggggataaccattggaaacgatggctaataccgcataacgccttcgggccaaagagggggaccttcgggcctctcgcgtcaggatatgcccaggtgggattagctagttggtgaggtaaaggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagcagtgaggaagggtgtgaagttaatagcttcatatcttgacgttagctgcagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaaccgcatttgaaactggcaggctagagtactgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccatagaacttagcagagatgctttggtgccttcgggaactatgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaa

SEQ ID NO: 9962 - DNA, 1563 bp, Vibrio ponticus
  misc_feature (1303)..(1303): n is a, c, g, or t
  ref <308>: DATABASE ACCESSION NUMBER: NCBI ACCESSION: NZ_RKIK01000002.1
  ref <309>: DATABASE ENTRY DATE: 2019-04-01
  ref <313>: RELEVANT RESIDUES IN SEQ ID NO: (1)..(1563)
aaattgaagagtttgatcatggctcagattgaacgctggcggcaggcctaacacatgcaagtcgagcggcagcgacaacattgaaccttcgggggatttgttgggcggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggttcatgcgttaatagcgtatggatttgacgttacctacagaagaagcaccggctaactccgtgccagcagccgcggtaatacggagggtgcgagcgttaatcggaattactgggcgtaaagcgcatgcaggtggttagttaagtcagatgtgaaagcccggggctcaacctcggaattgcatttgaaactggctgactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccatagaacttagcagagatgctttggtgccttcgggaactatgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgtatacagagggctgccaaccagcgatggtgagcgaatcccaaaaagtncgtcgtagtccggattggagtctgcaactcgactccatgaagtcggaatcgctagtaatcgtggatcagaatgccacggtgaaatacgttcccgggccttgtacacaccgcccgtcacaccatgggagtgggctgcaaaagaagtgggtagtttaaccttcgggaggacgctcaccactttgtggttcatgactggggtgaagtcgtaacaaggtagcgctaggggaacctggcgctggatcacctccttatacgatgat

SEQ ID NO: 9963 - DNA, 1569 bp, Vibrio qinghaiensis
  ref <308>: DATABASE ACCESSION NUMBER: NCBI ACCESSION: NZ_CP022741.1
  ref <309>: DATABASE ENTRY DATE: 2019-04-01
  ref <313>: RELEVANT RESIDUES IN SEQ ID NO: (1)..(1569)
ttaattgaagagtttgatcatggctcagattgaacgctggcggcaggcctaacacatgcaagtcgagcggcagcacagaggaacttgttccttgggtggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaaggtggtgttgttaatagcagcatcatttgacgttagcgacagaagaagcaccggctaactccgtgccagcagccgcggtaatacggagggtgcgagcgttaatcggaattactgggcgtaaagcgcatgcaggtggtggattaagtcagatgtgaaagcccggggctcaacctcggaaccgcatttgaaactggttcactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatctacagaatcctgcggagacgcgggagtgccttcgggaactgtaagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaccagaagtggttagtttaaccgcactttcttcggagagagtggaggacgatcaccacggtgtggttcatgactggggtgaagtcgtaacaaggtagcgctaggggaacctggcgctggatcacctccttatacgaagat

SEQ ID NO: 9964 - DNA, 1562 bp, Vibrio rhodolitus
  ref <308>: DATABASE ACCESSION NUMBER: NCBI ACCESSION: NZ_QLYZ01000042.1
  ref <309>: DATABASE ENTRY DATE: 2019-04-01
  ref <313>: RELEVANT RESIDUES IN SEQ ID NO: (1)..(1562)
aaattgaagagtttgatcatggctcagattgaacgctggcggcaggcctaacacatgcaagtcgagcggcagcgacaacattgaaccttcgggggatttgttgggcggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggttcatgcgttaatagcgtatggatttgacgttacctacagaagaagcaccggctaactccgtgccagcagccgcggtaatacggagggtgcgagcgttaatcggaattactgggcgtaaagcgcatgcaggtggttagttaagtcagatgtgaaagcccggggctcaacctcggaattgcatttgaaactggctgactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccatagaacttagcagagatgctttggtgccttcgggaactatgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggctgccaaccagcgatggtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtgggtagtttaaccttcgggaggacgctcaccactttgtggttcatgactggggtgaagtcgtaacaaggtagcgctaggggaacctggcgctggatcacctccttatacgatgat

SEQ ID NO: 9965 - DNA, 1563 bp, Vibrio rotiferianus
  ref <308>: DATABASE ACCESSION NUMBER: NCBI ACCESSION: NZ_APHW01000036.1
  ref <309>: DATABASE ENTRY DATE: 2019-04-01
  ref <313>: RELEVANT RESIDUES IN SEQ ID NO: (1)..(1563)
aaattgaagagtttgatcatggctcagattgaacgctggcggcaggcctaacacatgcaagtcgagcggaaacgagttatctgaaccttcgggggacgataacggcgtcgagcggcggacgggtgagtaatgcctaggaaattgccctgatgtgggggataaccattggaaacgatggctaataccgcataatgcctacgggccaaagagggggaccttcgggcctctcgcgtcaggatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagtcgtgaggaaggtagtgtagttaatagctgcattatttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaattgcatttgaaactggcagactagagtactgtagagggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagccaacttgcgagagtgagcgaatcccaaaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggctgcaaaagaagtaggtagtttaaccttcgggaggacgcttaccactttgtggttcatgactggggtgaagtcgtaacaaggtagcgctaggggaacctggcgctggatcacctccttatacgatgat

SEQ ID NO: 9966 - DNA, 1553 bp, Vibrio sp. 03 296
  ref <308>: DATABASE ACCESSION NUMBER: NCBI ACCESSION: NZ_NPKW01001161.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggcagcacagagaaacttgtttctcgggtggcgagcggcggacgggtgagtaatgcctgggaaattgccctgatgtgggggataaccattggaaacgatggctaataccgcatgatagcttcggctcaaagagggggaccttcgggcctctcgcgtcaggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagtcgtgaggaaggtggtagtgttaatagcrctatcatttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaactgcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgctgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatctagcggagacgctggagtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggckgccaacttgcgaaagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtgggtagtttaaccttcgggaggacgctcaccactttgtggttcatgactggggtgaagtcgtaacaaggtagcgctaggggaacctggcgctggatcacctccttatacgatgat

SEQ ID NO: 9967 - DNA, 1566 bp, Vibrio sp. 10N.222.47.A9
  ref <308>: DATABASE ACCESSION NUMBER: NCBI ACCESSION: NZ_MKKN01000101.1
  ref <309>: DATABASE ENTRY DATE: 2019-04-01
  ref <313>: RELEVANT RESIDUES IN SEQ ID NO: (1)..(1566)
aaattgaagagtttgatcatggctcagattgaacgctggcggcaggcctaacacatgcaagtcgagcggaaacgacactaacaatccttcgggtgcgttaatgggcgtcgagcggcggacgggtgagtaatgcctaggaaattgccttgatgtgggggataaccattggaaacgatggctaataccgcataatgcctacgggccaaagagggggatcttcggacctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagttgtgaggaagggggtaacgttaatagcgttatctcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtgctgtagaggggggtagaatttcaggtgtagcggtgaaatgcgtagagatctgaaggaataccagtggcgaaggcggccccctggacagacactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagccctaggggaacctggggctggatcacctccttatacgaagatac

SEQ ID NO: 9968 - DNA, 1462 bp, Vibrio sp. 10N.261.54.C3
  ref <308>: DATABASE ACCESSION NUMBER: NCBI ACCESSION: NZ_MCXG01000069.1
  ref <309>: DATABASE ENTRY DATE: 2019-04-01
  ref <313>: RELEVANT RESIDUES IN SEQ ID NO: (1)..(1462)
ggcgtcgagcggcggacgggtgagtaatgcctaggaaattgccttgatgtgggggataaccattggaaacgatggctaataccgcataatgcctacgggccaaagagggggaccttcgggcctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagttgtgaggaagggggtagtgttaatagcgctatctcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtactgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggagctctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagccctaggggaacctggggctggatcacctccttatacgaagata

SEQ ID NO: 9969 - DNA, 1545 bp, Vibrio sp. 11986-1-5
  ref <308>: DATABASE ACCESSION NUMBER: NCBI ACCESSION: NZ_QHMB01000024.1
  ref <309>: DATABASE ENTRY DATE: 2019-04-01
  ref <313>: RELEVANT RESIDUES IN SEQ ID NO: (1)..(1545)
aaattgaagagtttgatcatggctcagattgaacgctggcggcaggcctaacacatgcaagtcgagcggtaacaggaaggaagcttgctttctttgctgacgagcggcggacgggtgagtaatgcctgggaaattgccctgatgtgggggataaccattggaaacgatggctaataccgcatgatgcctacgggccaaagagggggaccttcgggcctctcgcgtcaggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtggtgaggaagggggtgtggttaatagccatattctttgacgttagccacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggagttgcatttgaaactggcaggctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgctgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatcctgcggagacgcgggagtgccttcgggagctctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgcatacagagggcggcgagctagcgatagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctcctta

SEQ ID NO: 9970 - DNA, 1333 bp, Vibrio sp. 2017V-1176
  ref <308>: DATABASE ACCESSION NUMBER: NCBI ACCESSION: NZ_QKKW01000047.1
  ref <309>: DATABASE ENTRY DATE: 2019-04-01
  ref <313>: RELEVANT RESIDUES IN SEQ ID NO: (1)..(1333)
gctaccggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtagggaggaaggtggttaagttaataccttaatcatttgacgttacctacagaagaagcaccggctaactccgtgccagcagccgcggtaatacggagggtgcaagcgttaatcggaattactgggcgtaaagcgcatgcaggtggtttgttaagtcagatgtgaaagccctgggctcaacctaggagttgcatttgaaactgacaagctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtgacctagagtcgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaatctagcggagacgctggagtgccttcgggagctctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgtatacagagggcagcgataccgcgaggtggagcgaatctcacaaagtacgtcgtagtccggattggagtctgcaactcgactccatgaagtcggaatcgctagtaatcgcaaatcagaatgttgcggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctccttatacgatgat

SEQ ID NO: 9971 - DNA, 1375 bp, Vibrio sp. 624788
  ref <308>: DATABASE ACCESSION NUMBER: NCBI ACCESSION: NZ_ANBW01000373.1
  ref <309>: DATABASE ENTRY DATE: 2019-04-01
  ref <313>: RELEVANT RESIDUES IN SEQ ID NO: (1)..(1375)
aatgggcgtcgagcggcggacgggtgagtaatgcctaggaaattgccttgatgtgggggataaccattggaaacgatggctaataccgcataatgcctacgggccaaagagggggaccttcgggcctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagttgtgaggaagggggtagcgttaatagcgctatctcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtactgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggagctctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagccagcgatggtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaacctttcggggaggacg

SEQ ID NO: 9972 - DNA, 1513 bp, Vibrio sp. 712i1
  ref <308>: DATABASE ACCESSION NUMBER: NCBI ACCESSION: NZ_ANBX01000163.1
  ref <309>: DATABASE ENTRY DATE: 2019-04-01
  ref <313>: RELEVANT RESIDUES IN SEQ ID NO: (1)..(1513)
aacacatgcaagtcgagcggaaacgagttatctgaaccttcggggaacgataacggcgtcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagtcgtgaggaaggtagtgtagttaatagctgcattatttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaatagcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgaaagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtaggtagtttaaccttcggggggacgcttaccactttgtggttcatgactggggtgaagtcgtaacaaggtagcgctaggggaacctggcgctggatcacctccttatacgatgat

SEQ ID NO: 9973 - DNA, 1558 bp, Vibrio sp. BEI207
  ref <308>: DATABASE ACCESSION NUMBER: NCBI ACCESSION: NZ_RXZH01000032.1
  ref <309>: DATABASE ENTRY DATE: 2019-04-01
  ref <313>: RELEVANT RESIDUES IN SEQ ID NO: (1)..(1558)
aaattgaagagtttgatcatggctcagattgaacgctggcggcaggcctaacacatgcaagtcgagcggaaacgacttaactgaaccttcggggaacgttaagggcgtcgagcggcggacgggtgagtaatgcctgggaaattgccctgatgtgggggataaccattggaaacgatggctaataccgcataatagcttcggctcaaagagggggaccttcgggcctctcgcgtcaggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagcagtgaggaaggtggtgywgttaatagcwgyatcatttgacgttagctgcagaagaagcaccggctaactccgtgccagcagccgcggtaatacggagggtgcgagcgttaatcggaattactgggcgtaaagcgcatgcaggtggttcgttaagtcagatgtgaaagcccggggctcaacctcggaatwgcatttgaaactggcggactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaaytttccagagatggattrgtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatccmaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtaggtagtttaaccttcgggagaacgcttaccactttgtggttcatgactggggtgaagtcgtaacaaggtagccctaggggaacctggggctggatcacctccttatacga

SEQ ID NO: 9974 - DNA, 1457 bp, Vibrio sp. BEI233
  ref <308>: DATABASE ACCESSION NUMBER: NCBI ACCESSION: NZ_QVMU01000070.1
  ref <309>: DATABASE ENTRY DATE: 2019-04-01
  ref <313>: RELEVANT RESIDUES IN SEQ ID NO: (1)..(1457)
aaattgaagagtttgatcatggctcagattgaacgctggcggcaggcctaacacatgcaagtcgagcggtaacatttcaaaagcttgcttttgaagatgacgagcggcggacgggtgagtaatgcctgggaatatgccttgatgtgggggataaccattggaaacgatggctaataccgcataatgcctacgggccaaagagggggatcttcggacctctcgcgtcaagattagcccaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagtcgtgaggaaggttcatrcgttaatagcgtatggatttgacgttagcgacagaagaagcaccggctaactccgtgccagcagccgcggtaatacggagggtgcgagcgttaatcggaattactgggcgtaaagcgcatgcaggtggttcgttaagtcagatgtgaaagcccggggctcaacctcggaactgcatttgaaactggcggactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatcyagagaagccagcggagacgcaggtgtgccttcgggaactctragacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggctgccaaccagcgatggtgagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagtgggtagtttaacctttcg

SEQ ID NO: 9975 - DNA, 759 bp, Vibrio sp. Evd3
  ref <308>: DATABASE ACCESSION NUMBER: NCBI ACCESSION: NZ_ORXW01000007.1
  ref <309>: DATABASE ENTRY DATE: 2019-04-01
  ref <313>: RELEVANT RESIDUES IN SEQ ID NO: (1)..(759)
aaattgaagagtttgatcatggctcagattgaacgctggcggcaggcctaacacatgcaagtcgagcggaaacgacactaacaatccttcgggtgcgttaatgggcgtcgagcggcggacgggtgagtaatgcctaggaaattgccttgatgtgggggataaccattggaaacgatggctaataccgcataatgcctacgggccaaagagggggaccttcgggcctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagttgtgaggaagggggtagtgttaatagcgctatctcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtactgtagaggggggtagaatttcaggtgtagcggtgaaatgcgtagagatctgaaggaataaaagtggcgaaggcggccccctggacagata

SEQ ID NO: 9976 - DNA, 1550 bp, Vibrio sp. Evh13
  ref <308>: DATABASE ACCESSION NUMBER: NCBI ACCESSION: NZ_OSDW01000040.1
  ref <309>: DATABASE ENTRY DATE: 2019-04-01
  ref <313>: RELEVANT RESIDUES IN SEQ ID NO: (1)..(1550)
cattggctcagattgaacgctggcggcaggcctaacacatgcaagtcgagcggaaacgacaacattgaatcttcggaggatttgttgggcgtcgagcggcggacgggtgagtaatgcctaggaaattgccttgatgtgggggataaccattggaaacgatggctaataccgcataatgcctacgggccaaagagggggaccttcgggcctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagttgtgaggaagggtgtgtagttaatagctgcacatcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtgctgtagaggggggtagaatttcaggtgtagcggtgaaatgcgtagagatctgaaggaataccagtggcgaaggcggccccctggacagacactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagccctaggggaacctggggctggatcacctccttatacgaagatac

SEQ ID NO: 9977 - DNA, 1554 bp, Vibrio sp. HBUAS61001
  ref <308>: DATABASE ACCESSION NUMBER: NCBI ACCESSION: NZ_CP033078.1
  ref <309>: DATABASE ENTRY DATE: 2019-04-01
  ref <313>: RELEVANT RESIDUES IN SEQ ID NO: (1)..(1554)
ttaattgaagagtttgatcatggctcagattgaacgctggcggcaggcctaacacatgcaagtcgagcggtaacagaaagaaagcttgctttctttgctgacgagcggcggacgggtgagtaatgcctgggaaattgccttgatgtgggggataaccattggaaacgatggctaataccgcataatgccttcgggccaaagagggggaccttcgggcctctcgcgtcaagatatgcccaggtgagattagcttgttggtgaggtaagagctcaccaaggcgacgatctctagctggtctgagaggatgatcagccacattgggactgagacacggcccaaactcctacgggaggcagcagtggggaatattgcacaatgggcgcaagcctgatgcagccatgccgcgtgtatgaagaaggccttcgggttgtaaagtactttcagcagtgaggaaggggtgatgtttaatagacaccattcttgacgttagctgcagaagaagcaccggctaactccgtgccagcagccgcggtaatacggagggtgcgagcgttaatcggaattactgggcgtaaagcgcatgcaggtggtctgttaagtcagatgtgaaagcccgaggcttaacctcggaatagcatttgaaactggcaggctagagtactgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgattgccagcacttcgggtgggaacttcagggagactgccggtgataaaccggaggaaggtggggacgacgtcaagtcatcatggcccttacgagtagggctacacacgtgctacaatggcgcatacagagggcagccaacttgcgaaagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagcaggtagtttaaccttcgggggggggcgcttgccactttgtggttcatgactggggtgaagtcgtaacaaggtagcgctaggggaacctggcgctggatcacctccttactacgaa

SEQ ID NO: 9978 - DNA, 1553 bp, Vibrio sp. LJC006
  ref <308>: DATABASE ACCESSION NUMBER: NCBI ACCESSION: NZ_RJVQ01000029.1
  ref <309>: DATABASE ENTRY DATE: 2019-04-01
  ref <313>: RELEVANT RESIDUES IN SEQ ID NO: (1)..(1553)
ttaattgaagagtttgatcatggctcagattgaacgctggcggcaggcctaacacatgcaagtcgagcggtaacagaaagaagcttgcttctttgctgacgagcggcggacgggtgagtaatgcctgggaaattgccctgatgtgggggataaccattggaaacgatggctaataccgcataatagcttcggctcaaagagggggaccttcgggcctctcgcgtcaggatatgcccaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagcagtgaggaaggcagtgagtttaatacgctyattgtttgacgttaactgcagaagaagcaccggctaactccgtgccagcagccgcggtaatacggagggtgcgagcgttaatcggaattactgggcgtaaagcgcatgcaggtggtctgttaagtcagatgtgaaagcccaaggcttaaccttggaatcgcatttgaaactggcaggctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccatagaacttagcagagatgctttggtgccttcgggaactatgagacaggtgctgcatggctgtcgtcagctcgtgttgtgaaatgttgggttaagtcccgcaacgagcgcaacccttatccttgtttgccagcgagtaaagtcgggaactccagggagactgccggtgataaaccggaggaaggtggggacgacgtcaagtcatcatggcccttacgagtagggctacacacgtgctacaatggcatatacagagggcggccaacttgcgaragtgagcgaatcccaaaaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagcaggtagtttaaccttcgggaggacgcttgccactttgtggttcatgactggggtgaagtcgtaacaaggtagcgctaggggaacctggcgctggatcacctccttacacgatgat

SEQ ID NO: 9979 - DNA, 1567 bp, Vibrio sp. SBT000027
  ref <308>: DATABASE ACCESSION NUMBER: NCBI ACCESSION: NZ_REBK01000004.1
  ref <309>: DATABASE ENTRY DATE: 2019-04-01
  ref <313>: RELEVANT RESIDUES IN SEQ ID NO: (1)..(1567)
aaattgaagagtttgatcatggctcagattgaacgctggcggcaggcctaacacatgcaagtcgagcggaaacgacaatattgaatcttcggaggatttgttgggcgtcgagcggcggacgggtgagtaatacctaggaaattgccttgatgtgggggataaccattggaaacgatggctaataccgcataatgcctacgggccaaagagggggatcttcggacctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagttgtgaggaagggggtagtgttaatagcgctatctcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtgctgtagaggggggtagaatttcaggtgtagcggtgaaatgcgtagagatctgaaggaataccagtggcgaaggcggccccctggacagacactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacggggggcccgcacaagcggtggagcatgtggtttaattcgatgcaacgcgaagaaccttacctactcttgacatccagagaagccagcggagacgcaggtgtgccttcgggagctctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagccctaggggaacctggggctggatcacctccttatacgaagata

SEQ ID NO: 9980 - DNA, 766 bp, Vibrio sp. T9
  ref <308>: DATABASE ACCESSION NUMBER: NCBI ACCESSION: NZ_NIGY01000038.1
  ref <309>: DATABASE ENTRY DATE: 2019-04-01
  ref <313>: RELEVANT RESIDUES IN SEQ ID NO: (1)..(766)
cagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaatagcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggc

SEQ ID NO: 9981 - DNA, 1555 bp, Vibrio sp. V02 P2A34T13
  ref <308>: DATABASE ACCESSION NUMBER: NCBI ACCESSION: NZ_PXJL01000124.1
  ref <309>: DATABASE ENTRY DATE: 2019-04-01
  ref <313>: RELEVANT RESIDUES IN SEQ ID NO: (1)..(1555)
ttaattgaagagtttgatcatggctcagattgaacgctggcggcaggcctaacacatgcaagtcgagcggcagcacagaggaacttgttccttgggtggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaaggtggtgttgttaatagcagcatcatttgacgttagcgacagaagaagcaccggctaactccgtgccagcagccgcggtaatacggagggtgcgagcgttaatcggaattactgggcgtaaagcgcatgcaggtggtggattaagtcagatgtgaaagcccggggctcaacctcggaaccgcatttgaaactggttcactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggaactctgagacaggtgctgcatggctgtcgtcagctcgtgttgtgaaatgttgggttaagtcccgcaacgagcgcaacccttatccttgtttgccagcgagtcatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagcgctaggggaacctggcgctggatcacctccttatacgaagat

SEQ ID NO: 9982 - DNA, 1555 bp, Vibrio sp. V03 P4A6T147
  ref <308>: DATABASE ACCESSION NUMBER: NCBI ACCESSION: NZ_NDIO01000240.1
  ref <309>: DATABASE ENTRY DATE: 2019-04-01
  ref <313>: RELEVANT RESIDUES IN SEQ ID NO: (1)..(1555)
ttaattgaagagtttgatcatggctcagattgaacgctggcggcaggcctaacacatgcaagtcgagcggcagcacagaggaacttgttccttgggtggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaaggtggtgttgttaatagcagcatcatttgacgttagcgacagaagaagcaccggctaactccgtgccagcagccgcggtaatacggagggtgcgagcgttaatcggaattactgggcgtaaagcgcatgcaggtggtggattaagtcagatgtgaaagcccggggctcaacctcggaaccgcatttgaaactggttcactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggagctctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagcgctaggggaacctggcgctggatcacctccttatacgaagat

SEQ ID NO: 9983 - DNA, 1555 bp, Vibrio sp. V04 P4A5T148; identical to SEQ ID NO: 9981
  ref <308>: DATABASE ACCESSION NUMBER: NCBI ACCESSION: NZ_NDHZ01000093.1
  ref <309>: DATABASE ENTRY DATE: 2019-04-01
  ref <313>: RELEVANT RESIDUES IN SEQ ID NO: (1)..(1555)

SEQ ID NO: 9984 - DNA, 1555 bp, Vibrio sp. V05 P4A8T149; identical to SEQ ID NO: 9981
  ref <308>: DATABASE ACCESSION NUMBER: NCBI ACCESSION: NZ_NDIA01000140.1
  ref <309>: DATABASE ENTRY DATE: 2019-04-01
  ref <313>: RELEVANT RESIDUES IN SEQ ID NO: (1)..(1555)

SEQ ID NO: 9985 - DNA, 1555 bp, Vibrio sp. V06 P1A73T115; identical to SEQ ID NO: 9981
  ref <308>: DATABASE ACCESSION NUMBER: NCBI ACCESSION: NZ_NDIB01000328.1
  ref <309>: DATABASE ENTRY DATE: 2019-04-01
  ref <313>: RELEVANT RESIDUES IN SEQ ID NO: (1)..(1555)

SEQ ID NO: 9986 - DNA, 1555 bp, Vibrio sp. V07 P2A8T137; identical to SEQ ID NO: 9981
  ref <308>: DATABASE ACCESSION NUMBER: NCBI ACCESSION: NZ_NDIC01000265.1
  ref <309>: DATABASE ENTRY DATE: 2019-04-01
  ref <313>: RELEVANT RESIDUES IN SEQ ID NO: (1)..(1555)

SEQ ID NO: 9987 - DNA, 1555 bp, Vibrio sp. V08 P9A1T1
  ref <308>: DATABASE ACCESSION NUMBER: NCBI ACCESSION: NZ_NDID01000188.1
  ref <309>: DATABASE ENTRY DATE: 2019-04-01
  ref <313>: RELEVANT RESIDUES IN SEQ ID NO: (1)..(1555)
ttaattgaagagtttgatcatggctcagattgaacgctggcggcaggcctaacacatgcaagtcgagcggcagcacagaggaacttgttccttgggtggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaaggtggtgttgttaatagcagcatcatttgacgttagcgacagaagaagcaccggctaactccgtgccagcagccgcggtaatacggagggtgcgagcgttaatcggaattactgggcgtaaagcgcatgcaggtggtggattaagtcagatgtgaaagcccggggctcaacctcggaaccgcatttgaaactggttcactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatctacagaatcctgcggagacgcgggagtgccttcgggaactgtaagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagcgctaggggaacctggcgctggatcacctccttatacgaagat

SEQ ID NO: 9988 - DNA, 1555 bp, Vibrio sp. V09 P4A23P171; identical to SEQ ID NO: 9981
  ref <308>: DATABASE ACCESSION NUMBER: NCBI ACCESSION: NZ_NDIE01000026.1
  ref <309>: DATABASE ENTRY DATE: 2019-04-01
  ref <313>: RELEVANT RESIDUES IN SEQ ID NO: (1)..(1555)

SEQ ID NO: 9989 - DNA, 1555 bp, Vibrio sp. V10 P2A27P122; identical to SEQ ID NO: 9981
  ref <308>: DATABASE ACCESSION NUMBER: NCBI ACCESSION: NZ_NDIF01000236.1
  ref <309>: DATABASE ENTRY DATE: 2019-04-01
  ref <313>: RELEVANT RESIDUES IN SEQ ID NO: (1)..(1555)

SEQ ID NO: 9990 - DNA, 1555 bp, Vibrio sp. V12 P9A6T4
  ref <308>: DATABASE ACCESSION NUMBER: NCBI ACCESSION: NZ_NDIH01000014.1
  ref <309>: DATABASE ENTRY DATE: 2019-04-01
  ref <313>: RELEVANT RESIDUES IN SEQ ID NO: (1)..(1555)
ttaattgaagagtttgatcatggctcagattgaacgctggcggcaggcctaacacatgcaagtcgagcggcagcacagaggaacttgttccttgggtggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaaggtggtgttgttaatagcagcatcatttgacgttagcgacagaagaagcaccggctaactccgtgccagcagccgcggtaatacggagggtgcgagcgttaatcggaattactgggcgtaaagcgcatgcaggtggtggattaagtcagatgtgaaagcccggggctcaacctcggaaccgcatttgaaactggttcactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatctacaggatcctgcggagacgcgggagtgccttcgggaactgtaagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagcgctaggggaacctggcgctggatcacctccttatacgaagat

SEQ ID NO: 9991 - DNA, 1555 bp, Vibrio sp. V14 P6S14T42; identical to SEQ ID NO: 9981
  ref <308>: DATABASE ACCESSION NUMBER: NCBI ACCESSION: NZ_NDII01000097.1
  ref <309>: DATABASE ENTRY DATE: 2019-04-01
  ref <313>: RELEVANT RESIDUES IN SEQ ID NO: (1)..(1555)

SEQ ID NO: 9992 - DNA, 1555 bp, Vibrio sp. V15 P4S5T153
  ref <308>: DATABASE ACCESSION NUMBER: NCBI ACCESSION: NZ_NDIJ01000017.1
  ref <309>: DATABASE ENTRY DATE: 2019-04-01
  ref <313>: RELEVANT RESIDUES IN SEQ ID NO: (1)..(1555)
ttaattgaagagtttgatcatggctcagattgaacgctggcggcaggcctaacacatgcaagtcgagcggcagcacagaggaacttgttccttgggtggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaaggtggtgttgttaatagcagcatcatttgacgttagcgacagaagaagcaccggctaactccgtgccagcagccgcggtaatacggagggtgcgagcgttaatcggaattactgggcgtaaagcgcatgcaggtggtggattaagtcagatgtgaaagcccggggctcaacctcggaaccgcatttgaaactggttcactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagcgctaggggaacctggcgctggatcacctccttatacgaagat

SEQ ID NO: 9993 - DNA, 1555 bp, Vibrio sp. V17 P4S1T151
  ref <308>: DATABASE ACCESSION NUMBER: NCBI ACCESSION: NZ_NDIK01000333.1
  ref <309>: DATABASE ENTRY DATE: 2019-04-01
  ref <313>: RELEVANT RESIDUES IN SEQ ID NO: (1)..(1555)
ttaattgaagagtttgatcatggctcagattgaacgctggcggcaggcctaacacatgcaagtcgagcggcagcacagaggaacttgttccttgggtggcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaaggtggtgttgttaatagcagcatcatttgacgttagcgacagaagaagcaccggctaactccgtgccagcagccgcggtaatacggagggtgcgagcgttaatcggaattactgggcgtaaagcgcatgcaggtggtggattaagtcagatgtgaaagcccggggctcaacctcggaaccgcatttgaaactggttcactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggctgcaaaagaagtgggtagtttaacctttcgaggaggacgctcaccactttgtggttcatgactggggtgaagtcgtaacaaggtagcgctaggggaacctggcgctggatcacctccttatacgaagat

SEQ ID NO: 9994 - DNA, 1555 bp, Vibrio sp. V18 P1S4T112; identical to SEQ ID NO: 9981
  ref <308>: DATABASE ACCESSION NUMBER: NCBI ACCESSION: NZ_NDIL01000069.1
  ref <309>: DATABASE ENTRY DATE: 2019-04-01
  ref <313>: RELEVANT RESIDUES IN SEQ ID NO: (1)..(1555)

SEQ ID NO: 9995 - DNA, 1555 bp, Vibrio sp. V19 P1S1T109; identical to SEQ ID NO: 9981
  ref <308>: DATABASE ACCESSION NUMBER: NCBI ACCESSION: NZ_NDIM01000122.1
  ref <309>: DATABASE ENTRY DATE: 2019-04-01
  ref <313>: RELEVANT RESIDUES IN SEQ ID NO: (1)..(1555)

SEQ ID NO: 9996 - DNA, 1555 bp, Vibrio sp. V20 P4S3T152; identical to SEQ ID NO: 9993
  ref <308>: DATABASE ACCESSION NUMBER: NCBI ACCESSION: NZ_NDIN01000058.1
  ref <309>: DATABASE ENTRY DATE: 2019-04-01
  ref <313>: RELEVANT RESIDUES IN SEQ ID NO: (1)..(1555)

SEQ ID NO: 9997 - DNA, 1562 bp, Vibrio sp. dhg
  ref <308>: DATABASE ACCESSION NUMBER: NCBI ACCESSION: NZ_CP028943.1
  ref <309>: DATABASE ENTRY DATE: 2019-04-01
  ref <313>: RELEVANT RESIDUES IN SEQ ID NO: (1)..(1562)
aaattgaagagtttgatcatggctcagattgaacgctggcggcaggcctaacacatgcaagtcgagcggaaacgagttaactgaaccttcgggggacgttaacggcgtcgagcggcggacgggtgagtaatgcctaggaaattgccctgatgtgggggataaccattggaaacgatggctaataccgcatgatgcctacgggccaaagagggggaccttcgggcctctcgcgtcaggatatgcctaggtgggattagctagttggtgaggtaagggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtgtgaagaaggccttcgggttgtaaagcactttcagtcgtgaggaaggtttatacgttaatagcgtatagatttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaatagcatttgaaactggcagactagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaacttttcagagatgaattggtgccttcgggaactctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcggccaacttgcgaaagtgagcgaatcccaaaaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggctgcaaaagaagtaggtagtttaaccttcggggggacgcttaccactttgtggttcatgactggggtgaagtcgtaacaaggtagcgctaggggaacctggcgctggatcacctccttatacgatgat

SEQ ID NO: 9998 - DNA, 780 bp, Vibrio spartinae
  ref <308>: DATABASE ACCESSION NUMBER: NCBI ACCESSION: NZ_FSSB01000039.1
  ref <309>: DATABASE ENTRY DATE: 2019-04-01
  ref <313>: RELEVANT RESIDUES IN SEQ ID NO: (1)..(780)
cttttgacgttagctgcagaagaagcaccggctaactccgtgccagcagccgcggtaatacggagggtgcgagcgttaatcggaattactgggcgtaaagcgcatgcaggtggtcttttaagtcagatgtgaaagcccggggcttaaccccggagttgcatttgaaactgggaggctagagtactgtagaggggggtagaatttcaggtgtagcggtgaaatgcgtagagatctgaaggaataccggtggcgaaggcggccccctggacagatactgacactcagatgcgaaagcgtggggagcaaacaggattagataccctggtagtccacgccgtaaacgatgtctacttggaggttgttcccttgaggagtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccggaagagattctggtgtgccttcgggagctctgagacaggtgctgcatggctgtcgtcagctcgtgttgtgaaatgttgggttaagtcccgcaacgagcgcaacccttatccttgattgccagcacttcgggtgggaacttcagggagactgccggtgataaaccggaggaaggtggggacgacgtcaagtcatcatggcccttacgagtagggctacacacgtgctacaatggcgtatacagaggg

SEQ ID NO: 9999 - DNA, 1464 bp, Vibrio splendidus
  ref <308>: DATABASE ACCESSION NUMBER: NCBI ACCESSION: NZ_FLQQ01000040.1
  ref <309>: DATABASE ENTRY DATE: 2019-04-01
  ref <313>: RELEVANT RESIDUES IN SEQ ID NO: (1)..(1464)
tgggcgtcgagcggcggacgggtgagtaatgcctaggaaattgccttgatgtgggggataaccattggaaacgatggctaataccgcataatgcctacgggccaaagagggggatcttcggacctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagttgtgaggaagggggtaacgttaatagcgttatctcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtgctgtagaggggggtagaatttcaggtgtagcggtgaaatgcgtagagatctgaaggaataccagtggcgaaggcggccccctggacagacactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggagctctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagtgggtagtttaacctttcggggaggacgctcaccactttgtggttcatgactggggtgaagtcgtaacaaggtagccctaggggaacctggggctggatcacctccttatacgaagata

SEQ ID NO: 10000 - DNA, 1564 bp, Vibrio superstes
  ref <308>: DATABASE ACCESSION NUMBER: NCBI ACCESSION: NZ_BCUR01000004.1
  ref <309>: DATABASE ENTRY DATE: 2019-04-01
  ref <313>: RELEVANT RESIDUES IN SEQ ID NO: (1)..(1564)
ttaattgaagagtttgatcatggctcagattgaacgctggcggcaggcctaacacatgcaagtcgagcggaaacgatgattctgaaccttcggggaacgaattaggcgtcgagcggcggacgggtgagtaatgcctgggaaattgccctgatgtgggggataaccattggaaacgatggctaataccgcataacgtctacggaccaaagagggggaccttcgggcctctcgcttcaggatatgcccaggtgggattagctagttggtgaggtaatggctcaccaaggcgacgatccctagctggtctgagaggatgatcagccacactggaactgagacacggtccagactcctacgggaggcagcagtggggaatattgcacaatgggcgcaagcctgatgcagccatgccgcgtgtatgaagaaggccttcgggttgtaaagtactttcagtcgtgaggaaggcgttgaagttaatagcttcagcgtttgacgttagcgacagaagaagcaccggctaactccgtgccagcagccgcggtaatacggagggtgcgagcgttaatcggaattactgggcgtaaagcgcatgcaggtggtttgttaagtcagatgtgaaagcccggggctcaacctcggaaccgcatttgaaactggcaggctagagtactgtagaggggggtagaatttcaggtgtagcggtgaaatgcgtagagatctgaaggaataccagtggcgaaggcggccccctggacagatactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaactcgctagagatagcttggtgccttcgggaactctgagacaggtgctgcatggctgtcgtcagctcgtgttgtgaaatgttgggttaagtcccgcaacgagcgcaacccttatccttgtttgccagcacgtaatggtgggaactccagggagactgccggtgataaaccggaggaaggtggggacgacgtcaagtcatcatggcccttacgagtagggctacacacgtgctacaatggcgcatacagagggcggccaaccagcgatggtgagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagtgggtagtttaaccttcggggaggacgctcaccactttgtggttcatgactggggtgaagtcgtaacaaggtagccctaggggaacctggggctggatcacctccttatacgatgat

SEQ ID NO: 10001 - DNA, 1242 bp, Vibrio tasmaniensis
  ref <308>: DATABASE ACCESSION NUMBER: NCBI ACCESSION: NZ_MDBG01000233.1
  ref <309>: DATABASE ENTRY DATE: 2019-04-01
  ref <313>: RELEVANT RESIDUES IN SEQ ID NO: (1)..(1242)
cctctcgcgtcaagatatgcctaggtgggattagctagttggtgaggtaatggctcaccaaggcgacgatccctagctggtctgagaggatgatcagccacactggaactgagacacggtccagactcctacgggaggcagcagtggggaatattgcacaatgggcgaaagcctgatgcagccatgccgcgtgtatgaagaaggccttcgggttgtaaagtactttcagttgtgaggaagggtgtgtagttaatagctgcacatcttgacgttagcaacagaagaagcaccggctaactccgtgccagcagccgcggtaatacggagggtgcgagcgttaatcggaattactgggcgtaaagcgcatgcaggtggttcattaagtcagatgtgaaagcccggggctcaacctcggaactgcatttgaaactggtgaactagagtgctgtagaggggggtagaatttcaggtgtagcggtgaaatgcgtagagatctgaaggaataccagtggcgaaggcggccccctggacagacactgacactcagatgcgaaagcgtggggagcaaacaggattagataccctggtagtccacgccgtaaacgatgtctacttggaggttgtggccttgagccgtggctttcggagctaacgcgttaagtagaccgcctggggagtacggtcgcaagattaaaactcaaatgaattgacgggggcccgcacaagcggtggagcatgtggtttaattcgatgcaacgcgaagaaccttacctactcttgacatccagagaagccagcggagacgcaggtgtgccttcgggagctctgagacaggtgctgcatggctgtcgtcagctcgtgttgtgaaatgttgggttaagtcccgcaacgagcgcaacccttatccttgtttgccagcgagtaatgtcgggaactccagggagactgccggtgataaaccggaggaaggtggggacgacgtcaagtcatcatggcccttacgagtagggctacacacgtgctacaatggcgcatacagagggcagcaagctagcgatagtgagcgaatcccaaaaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggctgcaaaagaagtgggtagtttaacctttcg

SEQ ID NO: 10002 - DNA, 1532 bp, Vibrionimonas magnilacihabitans
  ref <308>: DATABASE ACCESSION NUMBER: NCBI ACCESSION: NZ_PVEQ01000042.1
  ref <309>: DATABASE ENTRY DATE: 2019-04-01
  ref <313>: RELEVANT RESIDUES IN SEQ ID NO: (1)..(1532)
tggagagtttgatcctggctcaggatgaacgctagcggcaggcttaatacatgcaagtcgaggggcagcagctttatagcaatatagaggctggcgaccggcaaacgggtgcggaacacgtacacaaccttccttgaatagggggatagcccatagaaatgtggattaataccccgtaatatagcggtgtggcatcacactgttattatagtttcggcgattcgagatgggtgtgcggctgattaggtagttggcggggtaaaggcccaccaagccttcgatcagtagctgatgtgagagcatgatcagccacacgggcactgagacacgggcccgactcctacgggaggcagcagtaaggaatattggtcaatggacgcaagtctgaaccagccatgccgcgtgaaggatgaaggtcctctggattgtaaacttcttttatagggggcgaaaaaaggtctttctagatcacttgacagtaccctatgaataagcaccggctaactccgtgccagcagccgcggtaatacggagggtgcaagcgttatccggattcactgggtttaaagggtgcgtaggcgggtaggtaagtcagaggtgaaatcctggagcttaactccagaactgcctttgatactatctatcttgaatatggtggaggtaagcggaatatgtcatgtagcggtgaaatgcatagatatgacatagaacacctattgcgaaggcagcttactacgcctatattgacgctgaggcacgaaagcgtggggatcaaacaggattagataccctggtagtccacgccctaaacgatgattactcgacgtatgcgatacacagtatgcgtctgagcgaaagcattaagtaatccacctgggaagtacgaccgcaaggttgaaactcaaaggaattggcgggggtccgcacaagcggtggagcatgtggtttaattcgatgatacgcgaggaaccttacctgggctagaatgcagtctgaccgtgggtgaaagctcatttcgtagcaatacgcagattgtaaggtgctgcatggctgtcgtcagctcgtgccgtgaggtgttgggttaagtcccgcaacgagcgcaacccctatcattagttgccaacaggtaaagctgggaactctagtgaaactgccgtcgtaagacgcgaggaaggaggggatgatgtcaagtcatcatggcctttatgcccagggctacacacgtgctacaatggggtggacaaagggctgcgacacagtgatgtgaagcgaatcccaaaaaccacttctcagttcagatcggagtctgcaactcgactccgtgaagctggaatcgctagtaatcgtatatcagcaatgatacggtgaatacgttcccggaccttgcacacaccgcccgtcaagccatgggagccgggtgtacctaaagtcggtaaccgcaaggatctgcctagggtaaaatcggtgactggggctaagtcgtaacaaggtagccgtaccggaaggtgcggctggaatacctccttttagag

SEQ ID NO: 10003 - DNA, 1516 bp, Victivallales bacterium CCUG 44730
  ref <308>: DATABASE ACCESSION NUMBER: NCBI ACCESSION: NZ_CP027227.1
  ref <309>: DATABASE ENTRY DATE: 2019-04-01
  ref <313>: RELEVANT RESIDUES IN SEQ ID NO: (1)..(1516)
tttattttacggagagtttgatcctggctcagaacgaacgctggcggcatggattaggcatgcaagttgaacgaaccacttcggtggagagtagcggaagggtgaggaacgcgtgagtaatctgccccctagttgggaataacagttggaaacgactgctaataccgaatgtggcttcaatcctgcatgggatggaggctaaagatttatcgctaggggatgagctcgcgtcccattaggtagttggtgaggtaacggcccaccaagccgacgatgggtagctggtctgagaggatggtcagccacactgggactgagacactgcccagactcctacgggaggctgcagtcgagaatcttgggcaatgcgcgaaagcgtgacccagcaatgccgcgtgtgtgatgaaggccttcgggtcgtaaagcactgtctcccgtgacgaaatttgacggtagcggggaaggaagccacggctaactacgtgccagcagccgcggtaatacgtaggtggcgagcgttgttcggatttattgggcgtaaagggtctgtaggaggttcgttaaatacgaggtgaaatcccgaagctcaacttcggaactgccttgtagactgacggactagagtaccggagaggtaagcggaataccaggtgtagcggtggaatgcgtagatatctggtagaacaccaatagcgaaggcagcttgctggacggaaactgactctgaaagacgaaagcatggggagcaaacaggattagataccctggtagtccatgccgtaaacgttgtcaacttgatgtggggggatttagtcctctccgtatcgaagctaacgcgataagttgaccgcctggggactacggccgcaaggctaaaactcaaaggaattgacgggggcccgcacaagcggtggagcatgtggcttaattcgaggcaacgcgaagaaccttacctggtcttgaaatatatcggaccgcctgtgaaagcaggcttcccttcggggctgatatacaggtgctgcatggctgtcgtcagctcgtgccgtgaggtgttcggttaagtccggcaacgagcgcaacccgtgtcactagttgccatcaagtaatgttggggactctagtgagactgcctgtgttaagcaggaggaaggcgcggatgacgtcaagtcagtatggcccttacgaccagggctgcacacgtgctacaatggggggtacaatgggatgcaatgtcgcgaggcggagcaaatccacaaaacctctcttagttcagattgcagtctgcaactcgactgcatgaagttggaatcgctagtaaaggcgtatcagctacgacgccttgaatacgttcccgggccttgtacacaccgcccgtcacatcatgggagttgactgcacccgaaatcggtgatctaacctgcaaaggaagaagccgcctaaggtgtggtcgatgactgggatgaagtcgtaacaaggtagccgtaggggaacctgcggctggatcacctcctttcta

SEQ ID NO: 10004 - DNA, 1521 bp, Victivallis vadensis
  ref <308>: DATABASE ACCESSION NUMBER: NCBI ACCESSION: NZ_QEKH01000069.1
  ref <309>: DATABASE ENTRY DATE: 2019-04-01
  ref <313>: RELEVANT RESIDUES IN SEQ ID NO: (1)..(1521)
tttattttacggagagtttgatcctggctcagaacgaacgctggcggcatggattaggcatgcaagttgaacgaactccttcgggagtgagtagcgaaagggtgaggaacgcgtgagtaatctgcccataagttgggaacaacagttggaaacgactgctaataccgaatgtggctattgacccgcatgggtttttggctaaagatttatcgcttatggatgagctcgcgtcccattagctagttggtgaggtaacggcccaccaaggctacgatgggtagctggtctgagaggatggtcagccacactgggactgagacactgcccagactcctacgggaggctgcagtcgagaatcttgggcaatgcgcgaaagcgtgacccagcaatgccgcgtgcatgatgaaggccctcgggtcgtaaaatgctgtctcccgtgacgaataatgacggtagcggggaaggaagccacggctaactacgtgccagcagccgcggtaatacgtaggtggcgagcgttgttcggatttattgggcgtaaagggtctgtaggaggtttgttaaatacgaggtgaaatccgggggctcaacttccgaattgccttgtagactgatgaactagagtactggagaggtaagcggaataccaggtgtagcggtggaatgcgtagatatctggtagaacaccaatagcgaaggcagcttgctggacagaaactgactctgaaagacgaaagcatggggagcaaacaggattagataccctggtagtccatgccgtaaacgttgtcaacttgatgtgggcggatttagtcctgtccgtatcgaagctaacgcgataagttgaccgcctgggaactacggccgcaaggctaaaactcaaaggaattgacgggggcccgcacaagcggtggagcatgtggcttaattcgaggcaacgcgaagaaccttacctgggcttgaaatataccggaccggctgtgaaagcagtcttctcttcggagctggtatacaggtgctgcatggctgtcgtcagctcgtgccgtgaggtgttcggttaagtccggcaacgagcgcaacccgtgtcattagttgccaacaggtaatgctggggactctaatgagactgcctgtgttaagcaggaggaaggcgcggatgacgtcaagtcagtatggcccttacgcccagggctgcacacgtgctacaatggggggtacaatgagaagcgaagtcgcgaggcggagcaaatctacaaaacctctcttagttcagattgcagtctgcaactcgactgcatgaagttggaatcgctagtaaatgcgtatcagctacgacgcattgaatacgttcccgggccttgtacacaccgcccgtcacatcatgggagttgattgcacccgaaatcggtgatctaacctgcaaaggaagaagccgcctaaggtgtggtcgatgactgggatgaagtcgtaacaaggtagccgtaggggaacctgcggctggatcacctcctttctaaggag

SEQ ID NO: 10005 - DNA, 1572 bp, Virgibacillus alimentarius
  ref <308>: DATABASE ACCESSION NUMBER: NCBI ACCESSION: NZ_JFBD01000024.1
  ref <309>: DATABASE ENTRY DATE: 2019-04-01
  ref <313>: RELEVANT RESIDUES IN SEQ ID NO: (1)..(1572)
tttatggagagtttgatcttggctcaggacgaacgctggcggcgtgcctaatacatgcaagtcgagcgcgggaagcaaatcgatccccttcgggggtgacgtttgtggaacgagcggcggacgggtgagtaacacgtgggcaacctgcctgtaagattgggataactcgcggaaacgtgagctaataccgaatgacacttttcatcgcctgatgggaagttaaaaggcggcatttgctgtcacttacagatgggcccgcggcgcattagctagttggtgagataaaagctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtattgttcgaataggacagtaccttgacggtacttaaccagaaagccccggctaactacgtgccagcagccgcggtaatacgtagggggcgagcgttgtccggaattattgggcgtaaagcgcgcgcaggcggtcttttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagctacgcgaagaaccttaccaggtcttgacatcctctgctatcggtagagataccgagttcccttcggggacagagtgacaggtggtgcatggttgtcgtcagctcgtgtcgtgagatgttgggttaagtcccgtaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggcagcgaagcggcaacgtgttagcaaatcccataaaaccattctcagttcggattgtaggctgcaactcgcctacatgaagcaggaatcgctagtaatcgcggatcagcatgccgcggtgaatacgttcccgggtcttgtacacaccgcccgtcacaccacgagagttggcaacacccgaagtcggtgaggtaacacttttgtgagccagccgccgaaggtggggccaatgattggggtgaagtcgtaacaaggtagccgtatcggaaggtgcggctggatcacctcctttctaa

SEQ ID NO: 10006 - DNA, 1045 bp, Virgibacillus chiguensis
  ref <308>: DATABASE ACCESSION NUMBER: NCBI ACCESSION: NZ_FQXD01000045.1
  ref <309>: DATABASE ENTRY DATE: 2019-04-01
  ref <313>: RELEVANT RESIDUES IN SEQ ID NO: (1)..(1045)
cccggctaactacgtgccagcagccgcggtaatacgtagggggcaagcgttgtccggaattattgggcgtaaagcgcgcgcaggcggtcctttaagtctgatgtgaaagcccacggcttaaccgtggagggccattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacacccctagagatagggcattcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggcagcgaagccgcgaggccaagcaaatcccataaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 10007 - DNA, 1569 bp, Virgibacillus dokdonensis
  ref <308>: DATABASE ACCESSION NUMBER: NCBI ACCESSION: NZ_LT745763.1
  ref <309>: DATABASE ENTRY DATE: 2019-04-01
  ref <313>: RELEVANT RESIDUES IN SEQ ID NO: (1)..(1569)
tttatggagagtttgatcttggctcaggacgaacgctggcggcgtgcctaatacatgcaagtcgagcgcgggaagcaagcagatctctttcgggagtgacgcttgtggaacgagcggcggacgggtgagtaacacgtgggcaacctacctgtaagactgggataactccgggaaaccggggctaataccagatgaaacaaagcgtcgcatgacgcaatgttaaaaggcggcatatgctgtcacttacagatgggcccgcggcgcattagctagttggtgaggtaaaggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccattcgaataggttggcaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggccattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacacccctagagatagggcattcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggcagcgaagccgcgaggccaagcaaatcccataaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 10008 - DNA, 1570 bp, Virgibacillus halodenitrificans
  ref <308>: DATABASE ACCESSION NUMBER: NCBI ACCESSION: NZ_FUHR01000006.1
  ref <309>: DATABASE ENTRY DATE: 2019-04-01
  ref <313>: RELEVANT RESIDUES IN SEQ ID NO: (1)..(1570)
tttatggagagtttgatcttggctcaggacgaacgctggcggcgtgcctaatacatgcaagtcgagcgcgggaagcaagctgatcctcttcggaggtgacgcttgtggaacgagcggcggacgggtgagtaacacgtgggcaacctgcctgtaagactgggataaccccgggaaaccggggctaataccggataatacttttcatcacctgatggaaagttgaaaggtggcttttagctaccacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaatagggcggcaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggctcaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgacgcaacgcgaagaaccttaccaggtcttgacatcctctgcaatcggtagagataccgagttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggaagcaaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 10009 - DNA, 1567 bp, Virgibacillus pantothenticus
  ref <308>: DATABASE ACCESSION NUMBER: NCBI ACCESSION: NZ_LT727679.1
  ref <309>: DATABASE ENTRY DATE: 2019-04-01
  ref <313>: RELEVANT RESIDUES IN SEQ ID NO: (1)..(1567)
tatggagagtttgatcttggctcaggacgaacgctggcggcgtgcctaatacatgcaagtcgagcgcgggaagcaagcagatctccttcgggagtgacgtttgtggaacgagcggcggacgggtgagtaacacgtgggcaacctacctgtaagactgggataactccgggaaaccggggctaataccggatgatacatatcgtcgcatgacgagatgttgaaaggcggcatatgctgtcacttacagatgggcccgcggcgcattagctagttggtgagataaaagctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccattcgaataggttggcaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggccattggaaactgggggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacgcccctagagatagggagttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggcagcgaagccgcgaggccaagcaaatcccataaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 10010 - DNA, 1570 bp, Virgibacillus proomii
  ref <308>: DATABASE ACCESSION NUMBER: NCBI ACCESSION: NZ_FUFN01000010.1
  ref <309>: DATABASE ENTRY DATE: 2019-04-01
  ref <313>: RELEVANT RESIDUES IN SEQ ID NO: (1)..(1570)
ttttttggagagtttgatcttggctcaggacgaacgctggcggcgtgcctaatacatgcaagtcgagcgcgggaagcaagcagaaccccttcgggggtgacgcatgtggaacgagcggcggacgggtgagtaacacgtgggcaacctgcctgtaagactgggataactccgggaaaccggggctaataccggataatacgttttcttgcataaggagacgttaaaaggcggcgcaagctgtcacttacagatgggcccgcggcgcattagctagttggtggggtaaaagcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgaagaaggttttcggatcgtaaaactctgttgttagggaagaacaagtgccgttcaaatagggcggcaccttgacggtacctaaccagaaagccccggctaactacgtgccagcagccgcggtaatacgtagggggcaagcgttgtccggaattattgggcgtaaagcgcgcgcaggcggtcttttaagtctgatgtgaaagcccacggcttaaccgtggagggccattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcaaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacggccctagagatagggagttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggcagcgaagccgtgaggccaagcaaatcccacaaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaaccgtaaggagccagccgccgaaggtgggaccaatgattggggtgaagtcgtaacaaggtagccgtatcggaaggtgcggctggatcacctcctttctaa

SEQ ID NO: 10011 - DNA, 1567 bp, Virgibacillus siamensis
  ref <308>: DATABASE ACCESSION NUMBER: NCBI ACCESSION: NZ_FUIH01000006.1
  ref <309>: DATABASE ENTRY DATE: 2019-04-01
  ref <313>: RELEVANT RESIDUES IN SEQ ID NO: (1)..(1567)
ttttggagagtttgatcttggctcaggacgaacgctggcggcgtgcctaatacatgcaagtcgagcgcgggaagcagacggaagccttcgggtggaagtctgtggaacgagcggcggacgggtgagtaacacgtgggcaacctgcctgtaagattgggataactccgggaaaccggggctaataccgaatgaagcgcatcaccgcatggtgacgtgatgaaaggcggcttttagctgtcacttacagatgggcccgcggcgcattagctagttggtggggtaagagcttaccaaggcaacgatgcgtagccgacctgagagggtgatcggccacactgggactgagacacggcccagactcctacgggaggcagcagtagggaatcatccgcaatggacgaaagtctgacggtgcaacgccgcgtgagtgatgaaggttttcggatcgtaaaactctgttgtcagggaagaacaagtaccgtttgaataaggcggtaccgtgacggtacctgaccagaaagccccggctaactacgtgccagcagccgcggtaatacgtagggggcaagcgttgtccggaattattgggcgtaaagcgctcgcaggcggtcttttaagtctgatgtgaaatctcgcggctcaaccgcgaatggtcattggaaactggaggacttgagtacagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaggtgttagggggtttccgccccttagtgctgcagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgccagcgctggagacagcgtgttcccttcggggacagagtgacaggtggtgcatggttgtcgtcagctcgtgtcgtgagatgttgggttaagtcccgcaacgagcgcaacccttgatcttagttgccagcattaggttgggcactctaaggtgactgccggtgacaaaccggaggaaggtggggatgacgtcaaatcatcatgccccttatgacctgggctacacacgtgctacaatggatggaacaaagggcagcgaagccgcaaggtgcagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggcaacacccgaagtcggtgaggtaaccttttggagccagccgccgaaggtggggccaatgattggggtgaagtcgtaacaaggtagccgtatcggaaggtgcggctggatcacctcctttctaa

SEQ ID NO: 10012 - DNA, 942 bp, Virgibacillus soli
  ref <308>: DATABASE ACCESSION NUMBER: NCBI ACCESSION: NZ_LGPD01000015.1
  ref <309>: DATABASE ENTRY DATE: 2019-04-01
  ref <313>: RELEVANT RESIDUES IN SEQ ID NO: (1)..(942)
cttgcggctcaaccgtgagcggtcattggaaactggagaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatccttatgcctgccctagagatagggagttcccttcggggacataagtgacaggtggtgcatggttgtcgtcagctcgtgtcgtgagatgttgggttaagtcccgcaacgagcgcaacccttgaaattagttgccagcatttagttgggcactctaatttgactgccggtgacaaaccggaggaaggtggggatgacgtcaaatcatcatgccccttatgacctgggctacacacgtgctacaatggatggtacagagggctgcgagaccgcgaggtttagccaatcccttaaaaccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaaggaa

SEQ ID NO: 10013 - DNA, 1569 bp, Virgibacillus sp. 6R
  ref <308>: DATABASE ACCESSION NUMBER: NCBI ACCESSION: NZ_CP017762.1
  ref <309>: DATABASE ENTRY DATE: 2019-04-01
  ref <313>: RELEVANT RESIDUES IN SEQ ID NO: (1)..(1569)
tttatggagagtttgatcttggctcaggacgaacgctggcggcgtgcctaatacatgcaagtcgagcgcgggaagcaagcagatctccttcgggggtgacgcttgtggaacgagcggcggacgggtgagtaacacgtgggcaacctacctgtaagactgggataaccccgggaaaccggggctaataccggatgatacatatcgtcgcatgacgagatgttgaaaggcggcatatgctgtcacttacagatgggcccgcggcgcattagctagttggtgagataaaagctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccattcgaataggttggcaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggccattggaaactgggggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacgcccctagagatagggagttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggcagcgaagccgcgaggccaagcaaatcccataaaaccattctcagttcggattgcaggctgcaactcgcctgcatgaagccggaatcgctagtaatcgcggatcagcatgccgcggtgaatacgttcccgggtcttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 10014 - DNA, 1573 bp, Virgibacillus sp. CM-4
  ref <308>: DATABASE ACCESSION NUMBER: NCBI ACCESSION: NZ_AUQA01000011.1
  ref <309>: DATABASE ENTRY DATE: 2019-04-01
  ref <313>: RELEVANT RESIDUES IN SEQ ID NO: (1)..(1573)
tttattggagagtttgatcttggctcaggacgaacgctggcggcgtgcctaatacatgcaagtcgagcgcgggaagcaggcagaactccttcgggagtgatgcctgtggaacgagcggcggacgggtgagtaacacgtgggcaacctgcctgtaagactgggataaccccgggaaaccggggctaataccggataacactttttggtacatgccaagaagttgaaaggcggcctttttggctgtcacttacagatgggcccgcggcgcattagctagttggtagggtaacggcctaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccgttcaaatagggcggcaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggctcaaccgtggatggccattggaaactggaggacttgagtacagaagaggagagtggaattccacgtgtagcggtgaaatgcgtagagatgtggaggaacaccagtggcgaaggcgactctctggtctgtaactgacgctgaggtgcgaaagcgtggggagcgaacaggattagataccctggtagtccacgccgtaaacgttgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgaagcaacgcgaagaaccttaccaggtcttgacatcctctgacacccctagagatagggcattcccttcggggacagagtgacaggtggtgcatggttgtcgtcagctcgtgtcgtgagatgttgggttaagtcccgcaacgagcgcaacccttgatcttagttgccagcattgagttgggcactctaaggtgactgccggtgacaaaccggaggaaggtggggatgacgtcaaatcatcatgccccttatgacctgggctacacacgtgctacaatggatggaacaaagggcagcgaaaccgcaaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 10015 - DNA, 1570 bp, Virgibacillus sp. SK37
  ref <308>: DATABASE ACCESSION NUMBER: NCBI ACCESSION: NZ_CP007161.1
  ref <309>: DATABASE ENTRY DATE: 2019-04-01
  ref <313>: RELEVANT RESIDUES IN SEQ ID NO: (1)..(1570)
tttatggagagtttgatcttggctcaggacgaacgctggcggcgtgcctaatacatgcaagtcgagcgcgggaagcaagctgatcctcttcggaggtgacgcttgtggaacgagcggcggacgggtgagtaacacgtgggcaacctgcctgtaagactgggataaccccgggaaaccggggctaataccggataatacttttcatcacctgatggaaagttgaaaggtggcttcttgctaccacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcgaatagggcggcaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacgggggcccgcacaagcggtggagcatgtggtttaattcgacgcaacgcgaagaaccttaccaggtcttgacatcctctgcaatcggtagagataccgagttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggaacaaagggaagcaaaaccgcgaggtcaagcaaatcccataaaaccattctcagttcggattgcaggctgcaactcgcctgcatgaagccggaatcgctagtaatcgcggatcagcatgccgcggtgaatacgttcccgggccttgtacacaccgcccgtcacaccacgagagttggtaacacccgaagtcggtgaggtaaccttttggagccagccgccgaaggtgggaccaatgattggggtgaagtcgtaacaaggtagccgtatcggaaggtgcggctggatcacctcctttctaa

SEQ ID NO: 10016 - DNA, 1557 bp, Viridibacillus arenosi
  ref <308>: DATABASE ACCESSION NUMBER: NCBI ACCESSION: NZ_MSPW01000032.1
  ref <309>: DATABASE ENTRY DATE: 2019-04-01
  ref <313>: RELEVANT RESIDUES IN SEQ ID NO: (1)..(1557)
ttttatggagagtttgatcctggctcaggacgaacgctggcggcgtgcctaatacatgcaagtcgagcgaatgatgaagaagcttgcttcttctgatttagcggcggacgggtgagtaacacgtgggcaacctacctagtagattgggataactccgggaaaccggggctaataccgaataatccattttgtcacatggcaaaatgctgaaaggcggtttcggctgtcactactagatgggcccgcggtgcattagctagttggtggggtaacggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttagtaactgaacgtaccttgacggtaccttattagaaagccacggctaactacgtgccagcagccgcggtaatacgtaggtggcaagcgttgtccggatttattgggcgtaaagcgcgcgcaggtggtttcttaagtctgatgtgaaagcccacggctcaaccgtggagggtcattggaaactgggagacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggttgaaactcaaaggaattgacgggggcccgcacaagcggtggagcatgtggtttaattcgaagcaacgcgaagaaccttaccaggtcttgacatcccaatgaccgctctagagatagagttttcccttcggggacattggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaagagtcgctaactcgcgagggtatgctaatctcataaaatcgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtgaggtaacctttatggagccagccgccgaaggtgggatagatgattggggtgaagtcgtaacaaggtagccgtatcggaaggtgcggctggatcacctcctttcta

SEQ ID NO: 10017 - DNA, 1557 bp, Viridibacillus arvi
  ref <308>: DATABASE ACCESSION NUMBER: NCBI ACCESSION: NZ_LILB01000018.1
  ref <309>: DATABASE ENTRY DATE: 2019-04-01
  ref <313>: RELEVANT RESIDUES IN SEQ ID NO: (1)..(1557)
ttttatggagagtttgatcctggctcaggacgaacgctggcggcgtgcctaatacatgcaagtcgagcgaatgatgaagaagcttgcttcttctgatttagcggcggacgggtgagtaacacgtgggcaacctacctagtagattgggataactccgggaaaccggggctaataccgaataatccattttgtcacatggcaaaatgctgaaaggcggtttcggctgtcactactagatgggcccgcggtgcattagctagttggtggggtaatggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttagtaactgaacgtaccttgacggtaccttattagaaagccacggctaactacgtgccagcagccgcggtaatacgtaggtggcaagcgttgtccggatttattgggcgtaaagcgcgcgcaggtggtttcttaagtctgatgtgaaagcccacggctcaaccgtggagggtcattggaaactgggagacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggttgaaactcaaaggaattgacgggggcccgcacaagcggtggagcatgtggtttaattcgaagcaacgcgaagaaccttaccaggtcttgacatcccaatgaccgctctagagatagagttttcccttcggggacattggtgacaggtggtgcatggttgtcgtcagctcgtgtcgtgagatgttgggttaagtcccgcaacgagcgcaacccttgatcttagttgccatcatttagttgggcactctaaggtgactgccggtgacaaaccggaggaaggtggggatgacgtcaaatcatcatgccccttatgacctgggctacacacgtgctacaatggacgatacaaagagtcgctaactcgcgagggtatgctaatctcataaaatcgttctcagttcggattgtaggctgcaactcgcctacatgaagccggaatcgctagtaatcgtggatcagcatgccacggtgaatacgttcccgggccttgtacacaccgcccgtcacaccacgagagtttgtaacacccgaagtcggtgaggtaacctttatggggccagccgccgaaggtgggatagatgattggggtgaagtcgtaacaaggtagccgtatcggaaggtgcggctggatcacctcctttcta

SEQ ID NO: 10018 - DNA, 1557 bp, Viridibacillus sp. FSL H7-0596; identical to SEQ ID NO: 10016
  ref <308>: DATABASE ACCESSION NUMBER: NCBI ACCESSION: NZ_MSPV01000028.1
  ref <309>: DATABASE ENTRY DATE: 2019-04-01
  ref <313>: RELEVANT RESIDUES IN SEQ ID NO: (1)..(1557)

SEQ ID NO: 10019 - DNA, 1557 bp, Viridibacillus sp. FSL H8-0123; identical to SEQ ID NO: 10016
  ref <308>: DATABASE ACCESSION NUMBER: NCBI ACCESSION: NZ_MSPU01000016.1
  ref <309>: DATABASE ENTRY DATE: 2019-04-01
  ref <313>: RELEVANT RESIDUES IN SEQ ID NO: (1)..(1557)

SEQ ID NO: 10020 - DNA, 1555 bp, Viridibacillus sp. OK051
  ref <308>: DATABASE ACCESSION NUMBER: NCBI ACCESSION: NZ_PHTX01000001.1
  ref <309>: DATABASE ENTRY DATE: 2019-04-01
  ref <313>: RELEVANT RESIDUES IN SEQ ID NO: (1)..(1555)
tttatggagagtttgatcctggctcaggacgaacgctggcggcgtgcctaatacatgcaagtcgagcgaatgatgaagaagcttgcttcttctgatttagcggcggacgggtgagtaacacgtgggcaacctacctagtagattgggataactccgggaaaccggggctaataccgaataattcatttcacctcatggtgagatgctgaaaggcggtttcggctgtcactactagatgggcccgcggtgcattagctagttggtggggtaatggcctaccaaggcaacgatgcatagccgacctgagagggtgatcggccacattgggactgagacacggcccaaactcctacgggaggcagcagtagggaatcttccacaatggacgaaagtctgatggagcaacgccgcgtgagtgatgaaggttttcggatcgtaaaactctgttgtaagggaagaacaagtacgttagtaactgaacgtaccttgacggtaccttattagaaagccacggctaactacgtgccagcagccgcggtaatacgtaggtggcaagcgttgtccggatttattgggcgtaaagcgcgcgcaggtggtttcttaagtctgatgtgaaagcccacggctcaaccgtggagggtcattggaaactgggagacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagggggtttccgccccttagtgctgcagctaacgcattaagcactccgcctggggagtacggccgcaaggttgaaactcaaaggaattgacgggggcccgcacaagcggtggagcatgtggtttaattcgaagcaacgcgaagaaccttaccaggtcttgacatcccaatgaccgctctagagatagagttttcccttcggggacattggtgacaggtggtgcatggttgtcgtcagctcgtgtcgtgagatgttgggttaagtcccgcaacgagcgcaacccttaatcttagttgccatcatttagttgggcactctaaggtgactgccggtgacaaaccggaggaaggtggggatgacgtcaaatcatcatgccccttatgacctgggctacacacgtgctacaatggacggtacaaagagtcgctaactcgcgagggtatgctaatctcataaaaccgttctcagttcggattgtaggctgcaactcgcctacatgaagccggaatcgctagtaatcgtagatcagcatgctacggtgaatacgttcccgggccttgtacacaccgcccgtcacaccacgagagtttgtaacacccgaagtcggtgaggtaacctttatggagccagccgccgaaggtgggatagatgattggggtgaagtcgtaacaaggtagccgtatcggaaggtgcggctggatcacctcctttct

SEQ ID NO: 10021 - DNA, 1545 bp, Vogesella indigofera
  ref <308>: DATABASE ACCESSION NUMBER: NCBI ACCESSION: NZ_RBID01000009.1
  ref <309>: DATABASE ENTRY DATE: 2019-04-01
  ref <313>: RELEVANT RESIDUES IN SEQ ID NO: (1)..(1545)
agattgaactgaagagtttgatcctggctcagattgaacgctggcggcatgctttacacatgcaagtcgaacggtaacagggagcttgctccgctgacgagtggcgaacgggtgagtaatgcgtcggaacgtgccgagtagtgggggataacgcatcgaaaggtgtgctaataccgcatacgaactgaggttgaaagtgggggaccttcgggcctcacgctattcgagcggccgacgtctgattagctagttggtgaggtaaaggctcaccaaggcgacgatcagtagcgggtctgagaggatgatccgccacactgggactgagacacggcccagactcctacgggaggcagcagtggggaattttggacaatgggcgcaagcctgatccagccatgccgcgtgtctgaagaaggccttcgggttgtaaaggacttttgtccgggagcaaatgcctggtgttaatagcactgggagctgagagtaccggaagaataagcaccggctaactacgtgccagcagccgcggtaatacgtagggtgcaagcgttaatcggaattactgggcgtaaagcgtgcgcaggcggttttgtaagccagatgtgaaagccccgggctcaacctgggaactgcgtttggaactacaagactagagtgtgtcagaggggggtggaattccgcgtgtagcagtgaaatgcgtagagatgcggaggaacaccgatggcgaaggcagccccctgggataacactgacgctcatgcacgaaagcgtggggagcaaacaggattagataccctggtagtccacgccctaaacgatgtcaattagctgttgggggttagaatccttggtagcgtagctaacgcgtgaaattgaccgcctggggagtacggccgcaaggttaaaactcaaaggaattgacgggggcccgcacaagcggtggatgatgtggattaattcgatgcaacgcgaaaaaccttacctgctcttgacatgtacggaacttgccagagatggcttggtgcccgaaagggagccgtaacacaggtgctgcatggctgtcgtcagctcgtgtcgtgagatgttgggttaagtcccgcaacgagcgcaacccttgtcattagttgccatcattcagttgggcactctaatgagactgccggtgacaaaccggaggaaggtggggatgacgtcaagtcctcatggcccttatgagcagggcttcacacgtcatacaatggtcggtacagagggttgccaagccgcgaggtggagctaatctcttaaagccgatcgtagtccggattggagtctgcaactcgactccatgaagtcggaatcgctagtaatcgcaggtcagcatactgcggtgaatacgttcccgggccttgtacacaccgcccgtcacaccatgggagtggaatccgccagaagtgggtagggtaaccttagggagcccgcttaccacggtaggtttcatgactggggtgaagtcgtaacaaggtagccgtaggggaacctgcggctggatcacctcctttctag

SEQ ID NO: 10022 - DNA, 1480 bp, Vulcanibacillus modesticaldus
  ref <308>: DATABASE ACCESSION NUMBER: NCBI ACCESSION: NZ_MIJF01000073.1
  ref <309>: DATABASE ENTRY DATE: 2019-04-01
  ref <313>: RELEVANT RESIDUES IN SEQ ID NO: (1)..(1480)
ttttatggagagtttgatcctggctcaggacgaacgctggcggcgtgcctaatacatgcaagtcgagcgaagtttatgggagcttgctcctaataaacttagcggcggacgggtgagtaacacgtgggcaacctgcctgtaagactgggataaccccgggaaaccggagctaataccggataagctgttagtacgcatgtagataacagggaaagatggcgcaagctatcacttacagatgggcccgcggcgcattagctagttggtagggtaacggcctaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaagccccggctaactacgtgccagcagccgcggtaatacgtagggggcaagcgttgtccggaattattgggcgtaaagcgcgcgcaggcggctctttaagtctgatgtgaaagcccacggctcaaccgtggagggtcattggaaactggggagcttgagtgcaggagaggaaagtggaattccatgtgtagcggtgaaatgcgtagatatatggaggaacaccagtggcgaaggcggctttctggcctgtaactgacgctgaggcgcgaaagcgtggggagcaaacaggattagataccctggtagtccacgccgtaaacgatgagtgctaggtgttaggggtttcgacgcccttagtgccgcagttaacacattaagcactccgcctggggagtacggccgcaaggttgaaactcaaaggaattgacgggggcccgcacaagcagtggagcatgtggtttaattcgaagcaacgcgaagaaccttaccagggcttgacatcccgttgaccggtgtagagatacatctttttcttcggaaacaacggtgacaggtggtgcatggttgtcgtcagctcgtgtcgtgagatgttgggttaagtcccgcaacgagcgcaacccttgatcttagttgccagcattaagttgggcactctaaggtgactgccggtgacaaaccggaggaaggtggggatgacgtcaaatcatcatgccccttatgtcctgggctacacacgtgctacaatggctggtacaaagggtagcgaagccgtgaggccaagccaatcccaaaaagccagtctcagttcggattgtaggctgcaactcgcctacatgaagccggaattgctagtaatcgcggatcagcatgccgcggtgaatacgttcccgggccttgtacacaccgcccgtcacaccacgagagtttgcaacacccaaagtcggtgaggtaaccaatatggagccagccgcctaaggtggggcagatgattggggtgaagtcgtaacaaggtagccgtatcggaaggtgcggctggatcacctcctttctatggag

SEQ ID NO: 10023 - DNA, 1485 bp, Vulcanococcus limneticus
  ref <308>: DATABASE ACCESSION NUMBER: NCBI ACCESSION: NZ_NQLA01000085.1
  ref <309>: DATABASE ENTRY DATE: 2019-04-01
  ref <313>: RELEVANT RESIDUES IN SEQ ID NO: (1)..(1485)
aacggagagtttgatcctggctcaggatgaacgctggcggcgtgcttaacacatgcaagtcgaacgaaccttcgggttagtggcggacgggtgagtaacgcgtgggaatctgccctcaggagggggataacggttggaaacgaccgctaataccccatatgccgagaggtgaaatgagttttcgcctgaggatgagcccgcgtctgattagctagttggtgtggtaatggcgcaccaaggcttcgatcagtagctggtctgagaggatgatcagccacactgggactgagacacggcccagactcctacgggaggcagcagtggggaattttccgcaatgggcgaaagcctgacggagcaacgccgcgtgagggatgaaggcctctgggctgtaaacctcttttatcaaggaagaagatctgacggtacttgatgaataagccacggctaattccgtgccagcagccgcggtaatacgggagtggcaagcgttatccggaattattgggcgtaaagcgtccgcaggcggccttgaaagtctgtcgttaaagcgtggagcttaactccatttcggcgatggaaactacaaggctagagtgtggtaggggcagagggaattcccggtgtagcggtgaaatgcgtagatatcgggaagaacaccagtggcgaaggcgctctgctgggccataactgacgctcatggacgaaagccaggggagcgaaagggattagatacccctgtagtcctggccgtaaacgatgaacactaggtgtcgggggaatcgaccccctcggtgtcgtagccaacgcgttaagtgttccgcctggggagtacgcacgcaagtgtgaaactcaaaggaattgacgggggcccgcacaagcggtggagtatgtggtttaattcgatgcaacgcgaagaaccttaccagggtttgacatcctgcgaatcccttggaaacgagggagtgccttcgggagcgcagtgacaggtggtgcatggctgtcgtcagctcgtgtcgtgagatgttgggttaagtcccgcaacgagcgcaacccacgtctttagttgccagcattcagttgggcactctagagagaccgccggtgataaaccggaggaaggtgtggatgacgtcaagtcatcatgccccttacatcctgggctacacacgtactacaatgctacggacaaagggcagcaaactcgcgagagctagcaaatcccataaaccgtggctcagttcagatcgtaggctgcaactcgcctacgtgaaggaggaatcgctagtaatcgcaggtcagcatactgcggtgaatacgttcccgggccttgtacacaccgcccgtcacaccatggaagttggccacgcccgaagtcgttactccaacccgtaagggaggaggatgccgaaggtggggctgatgactggggtgaagtcgtaacaaggtagccgtaccggaaggtgcggctggatcacctcctaa

SEQ ID NO: 10024 - DNA, 1558 bp, Waddlia chondrophila
  ref <308>: DATABASE ACCESSION NUMBER: NCBI ACCESSION: NZ_LVEB01000075.1
  ref <309>: DATABASE ENTRY DATE: 2019-04-01
  ref <313>: RELEVANT RESIDUES IN SEQ ID NO: (1)..(1558)
ttttctttgagaatttgatcctggttcagattgaatgctgacggcgtggatgaggcatgcaagtcgaacgaagtgtgctcttgagtgcacttagtggcggaagggttagtaatacatgggtaatctacctttaactctgggataacggttggaaacgaccgctaataccggatatggtgctagagaggatctttttagcattaaagtgggggattgggcgaccgaccttacggttaaagaggggcccatgggatatcagctagttggtgaggtaaaggctcaccaaggctaagacgtctaggcgagttgagagattgaccgccaacactgggactgagacactgcccagactcctacgggaggctgcagtcgagaatctttcgcaatgggcgaaagcctgacgaagcgacgccgtgtgaatgaagaaggcccttgggtcgtaaagttctttcgcatgggaacaagagaaggatgctaatatcatctggatttgagcgtaccttgtaaagaagcaccggctaactccgtgccagcagctgcggtaatacggagggtgcgagcattaatcggatttattgggcgtaaagggggcgtaggctggaatataagtcagccgtgaaatcccggggctcaaccccggaactgcgtttgaaactatatttctagaggcaaggcggagaaaacggaattccacatgtagcggtgaaatgcgtagatatgtggaagaacaccagtggcgaaggcggttttctagctttgacctgacgctgatgcccgaaagctaggggagcgaacaggattagataccctggtagtcctagccgtaaacgatgcatacttggtgtagccggactcaaccctggctgtgccgtagctaacgcgttaagtatgccgcctggggagtacgcccgcaagggtaaaactcaaaagaattgacggggacccgcacaagcagtggagcatgtggtttaattcgatgcaacgcgaagaaccttacctgggcttgacatatatatgacggctctagagatagagtattccttcgggacatatatacaggtgctgcatggctgtcgtcagctcgtgccgtgaggtgttgggttaagtcccgcaacgagcgcaacccttatcgttagttgccagcatttaggatgggaactctaacgagactgcctgggttaaccaggaggaaggtgaggatgacgtcaagtccgcatggcccttatgtccagggctacacacgtgctacaatggcaggtacagaaggcagcgaaaccgcgaggtcaagcaaatcctacaaagcctgtcccagttcggattggagtctgcaactcggctccatgaagttggaattgctagtaatggcgtgtcagcaataacgccgtgaatacgttcccgggtcttgtacacaccgcccgtcacatcatgggagttggtttcacccgaagtcgctgacttaaccgcaagggaagaggtgccgaaggtgaggctgatgactgggatgaagtcgtaacaaggtagccgtaccggaaggtgcggctggatcacctcctttaaa

SEQ ID NO: 10025 - DNA, 308 bp, Weissella bombi
  ref <308>: DATABASE ACCESSION NUMBER: NCBI ACCESSION: NZ_FMAO01000006.1
  ref <309>: DATABASE ENTRY DATE: 2019-04-01
  ref <313>: RELEVANT RESIDUES IN SEQ ID NO: (1)..(308)
ttaaaatgagagtttgatcctggctcaggatgaacgctggcggcgtgcctaatacatgcaagtcgaacgctttgtgcttaattgagatgacgagcttgctctgatttgattttttgatttcaaagagtggcgaacgggtgagtaacacgtgggtaacctacctcttagcaggggataacatttggaaacaagtgctaataccgtataacatcaacaaccgcatggttgttgattgaaagatggttctgctatcactaagagatggacccgcggtgcattagctagttggtaaggtaatggcttaccaa

SEQ ID NO: 10026 - DNA, 1585 bp, Weissella ceti
  ref <308>: DATABASE ACCESSION NUMBER: NCBI ACCESSION: NZ_CP009224.1
  ref <309>: DATABASE ENTRY DATE: 2019-04-01
  ref <313>: RELEVANT RESIDUES IN SEQ ID NO: (1)..(1585)
ttcaaattgagagtttgatcctggctcaggatgaacgctggcggcgtgctaatacatgcaagtcgaacgcactgtggttcaactgatttgaagagcttgctctgatatgacgatgaacattgcagtgagtggcgaacgggtgagtaacacgtgggaaacctacctcttagcgggggataacatctggaaacagatgctaataccgcataacactagcaaccgcatggttgctacttgaaagatggttctgctatcactaagagatggtcccgcggacgcattagttagttcggtgaggtaatggctcaccaaagagatgatgcgtagccgagttgagagactgactcggccacaatgggactgagacacggcccatactcctacgggaggcagcagtagggaatcttccacaatggacgaaagtctgatggagcaacgccgcgtgtgtgatgaagggtttcggctcgtaaaacactgttgtaagagaagaatagcatcaagagtaactgcttggtgtgtgacggtatcttaccagaaaggaacggctaaatacgtgccagcagccgcggtaatacgtatgttccaagcgttatccggatttattgggcgtaaagcgagcgcagacggttttttaagtccgaagtgaaagccacagcttaactgtggaagtgctttggaaactggatgacttgagtgcagtagaggagagtggaattccatgtgtagcggtgaaatgcgtagatatatggaggaacaccagtggcgaaggcggctctctggactgtaactgacgttgaggctcgaaagtgtgggtagcaaacaggattagataccctggtagtccacaccgtaaacgatgagtgctagatgtttgggggtttccgcccctaagtgtcgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccacgccagaaatggcgctttcccttcggggacaaagtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgcccttatgacctgggctacacacgtgctacaatggcaagtacaacgagtcgctaacccgcgagtacgcaaatctcttaaagcttgtctcagttcggattgtaggctgcaactcgctacatgaagtcggaatcgctagtaatcgcggatcagcacgccgcggtgaatacgttcccgggtcttgtacacaccgcccgtcacaccatgagagtttgtaacacccaaagccggtgaggtaaccttttaggagccagccgtctaaggtgggatagatgattagggtgaagtcgtaacaaggtagccgtaggagaacctgcggctggatcacctcctttctaaggaa

SEQ ID NO: 10027 - DNA, 1585 bp, Weissella cibaria
  ref <308>: DATABASE ACCESSION NUMBER: NCBI ACCESSION: NZ_CP035267.1
  ref <309>: DATABASE ENTRY DATE: 2019-04-01
  ref <313>: RELEVANT RESIDUES IN SEQ ID NO: (1)..(1585)
caaattgagagtttgatcctggctcaggatgaacgctggcggcgtgcctaatacatgcaagtcgaacgctttgtggttcaactgatttgaagagcttgctcagatatgacgatggacattgcaaagagtggcgaacgggtgagtaacacgtgggaaacctacctcttagcaggggataacatttggaaacagatgctaataccgcataacaatagcaaccgcatggttgctacttaaaagatggttctgctatcactaagagatggtcccgcggtgcattagttagttggtgaggtaatggctcaccaagacgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctaggtgtttgagggtttccgcccttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaactccagagatggagcgttcccttcggggacaaggtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgacctgggctacacacgtgctacaatggcgtatacaacgagttgccaacccgcgagggtgagccaatctcttaaagtacgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttcgggagccagccgtctaaggtgggacagatgattagggtgaagtcgtaacaaggtagccgtaggagaacctgcggctggatcacctcctttctaaggaa

SEQ ID NO: 10028 - DNA, 1587 bp, Weissella confusa
  ref <308>: DATABASE ACCESSION NUMBER: NCBI ACCESSION: NZ_FUWE01000040.1
  ref <309>: DATABASE ENTRY DATE: 2019-04-01
  ref <313>: RELEVANT RESIDUES IN SEQ ID NO: (1)..(1587)
ttcaaattgagagtttgatcctggctcaggatgaacgctggcggcgtgcctaatacatgcaagtcgaacgctttgtggttcaactgatttgaagagcttgctcagatatgacgatggacattgcaaagagtggcgaacgggtgagtaacacgtgggaaacctacctcttagcaggggataacatttggaaacagatgctaataccgtataacaatgacaaccgcatggttgttatttaaaagatggttctgctatcactaagagatggtcccgcggtgcattagctagttggtaaggtaatggcttaccaaggcgatgatgcatagccgagttgagagactgatcggccacaatgggactgagacacggcccatactcctacgggaggcagcagtagggaatcttccacaatgggcgaaagcctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctaggtgtttgagggtttccgcccttaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaactccagagatggagcgttcccttcggggacaaggtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacctgggctacacacgtgctacaatggcgtatacaacgagttgccaacccgcgagggtgagctaatctcttaaagtacgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttcgggagccagccgtctaaggtgggacagatgattagggtgaagtcgtaacaaggtagccgtaggagaacctgcggctggatcacctcctttctaaggaa

SEQ ID NO: 10029 - DNA, 1587 bp, Weissella halotolerans
  ref <308>: DATABASE ACCESSION NUMBER: NCBI ACCESSION: NZ_JQAX01000007.1
  ref <309>: DATABASE ENTRY DATE: 2019-04-01
  ref <313>: RELEVANT RESIDUES IN SEQ ID NO: (1)..(1587)
aaaatgagagtttgatcctggctcaggataaacgctggcggcgtgcctaatacatgcaagtcgaacgccttgtcgttctactgatttagagagcttgctcaatactgacgtagaactatacaaggagtggcgaacgggtgagtaacacgtgggaaacctacctcttagtaggggataacacctggaaacaggtgctaataccgcataacaacgataaccgcatggttatcgcttgaaaggtggcgtaagctaccgctaagagatggtcccgcggtgcattagttagttggtgaggtaatggctcaccaagacgatgatgcatagccgagttgagagactgatcggccacaatgggactgagacacggcccatactcctacgggaggcagcagtagggaatcttccacaatggacgaaagtctgatggagcaacgccgcgtgtgtgatgaagggtttcggctcgtaaaacactgttgtaagagaagaatgatactaagagtaactgtttagtatgtgacggtatcttaccagaaaggaacggctaaatacgtgccagcagccgcggtaatacgtatgttccaagcgttatccggatttattgggcgtaaagcgagcgcagacggttatttaagtctgaagtgaaagcccacagcttaactgtggaagtgctttggaaactggataacttgagtgcagtagaggaaagtggaactccatgtgtagcggtgaaatgcgtagatatatggaagaacaccagcggcgaaggcggctttctggactgtaactgacgttgaggctcgaaagtgtgggtagcaaacaggattagataccctggtagtccacaccgtaaacgatgagtgctagatgtttgggggtttccgcccctaagtgtcgtagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccacctcagagatgaggctttcccttcggggacaaagtgacaggtggtgcatggttgtcgtcagctcgtgtcgtgagatgttgggttaagtcccgcaacgagcgcaacccttatgattagttgccagcatttagttgggcactctaatcagactgccggtgacaaaccggaggaaggtggggatgacgtcaaatcatcatgccccttatgacctgggctacacacgtgctacaatggcaagtacaacgagcagctaacccgtaagggcacgcgaatctcttaaaacttgtctcagttcggattgtgggctgcaactcgcccacatgaagtcggaatcgctagtaatcgcggatcagcacgccgcggtgaatacgttcccgggtcttgtacacaccgcccgtcacaccatgagagtttgtaacacccaaagccggtgaggtaacccgcaagggaaccagccgtctaaggtgggacagatgattagggtgaagtcgtaacaaggtagccgtaggagaacctgcggctggatcacctcctttctaaggaa

SEQ ID NO: 10030 - DNA, 317 bp, Weissella hellenica
  ref <308>: DATABASE ACCESSION NUMBER: NCBI ACCESSION: NZ_FMAW01000024.1
  ref <309>: DATABASE ENTRY DATE: 2019-04-01
  ref <313>: RELEVANT RESIDUES IN SEQ ID NO: (1)..(317)
ttaaaatgagagtttgatcctggctcaggatgaacgctggcggcgtgcctaatacatgcaagtcgaacgctttgtgcttaattgatatgacgagcttgctctgatttgattttttgatttcaaagagtggcgaacgggtgagtaacacgtgggtaacctacctcttagcaggggataacatttggaaacaagtgctaataccgtataataccaacaaccgcatggttgttggttgaaagatggttctgctatcactaagagatggacccgcggtgcattagctagttggtaaggtaatggcttaccaaggcaatgat

SEQ ID NO: 10031 - DNA, 1585 bp, Weissella jogaejeotgali
  ref <308>: DATABASE ACCESSION NUMBER: NCBI ACCESSION: NZ_CP014332.1
  ref <309>: DATABASE ENTRY DATE: 2019-04-01
  ref <313>: RELEVANT RESIDUES IN SEQ ID NO: (1)..(1585)
tttaaaatgagagtttgatcctggctcaggatgaacgctggcggcgtgcctaatacatgcaagtcgaacgctttgtctttaattgatctgacgagcttgctctgatgtgattttatctgacaaagagtggcgaacgggtgagtaacacgtgggtaacctacctcttagcaggggataacatttggaaacaagtgctaataccgtataatactaacaaccgcatggttgttaattgaaagatggttctgctatcactaagagatggacccgcggtgcattagctagttggtaaggtaatggcttaccaaggcgatgatgcgtagccgagttgagagactgatcggccacaatgggactgagacacggcccatactcctacgggaggcagcagtagggaatcttccacaatgggcgcaagcctgatggagcaacgccgcgtgtgtgatgaagggtttcggctcgtaaaacactgttataagagaagaacgacattgagagtaactgttcagtgtgtgacggtatcttatcagaaaggaacggctaaatacgtgccagcagccgcggtaatacgtatgttccaagcgttatccggatttattgggcgtaaagcgagcgcagacggttatttaagtctgaagtgaaagccctcagctcaactgaggaagggctttggaaactggataacttgagtgcagtagaggaaagtggaactccatgtgtagcggtgaaatgcgtagatatatggaagaacaccggtggcgaaagcggctttctggactgtaactgacgttgaggctcgaaagtgtgggtagcaaacaggattagataccctggtagtccacaccgtaaacgatgggtgctagatgttcgagggtttccgcccttgagtgtcgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgcaaatcctagaaataggatgttcccttcggggacaaggtgacaggtggtgcatggttgtcgtcagctcgtgtcgtgagatgttgggttaagtcccgcaacgagcgcaacccttattattagttgccagcattcagttgggcactctagtgagactgccggtgacaaaccggaggaaggtggggatgacgtcaaatcatcatgccccttatgacctgggctacacacgtgctacaatggcatatacaacgagtcgctaacccgcgagggtacgctaatctcttaaagtatgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtgcggtaaccttttaggagccaaccgtctaaggtgggacagatgattagggtgaagtcgtaacaaggtagccgtaggagaacctgcggctggatcacctcctttctaaggaa

SEQ ID NO: 10032 - DNA, 1589 bp, Weissella kandleri
  ref <308>: DATABASE ACCESSION NUMBER: NCBI ACCESSION: NZ_JQBP01000013.1
  ref <309>: DATABASE ENTRY DATE: 2019-04-01
  ref <313>: RELEVANT RESIDUES IN SEQ ID NO: (1)..(1589)
tttaaattgagagtttgatcctggctcaggatgaacgctggcggcgtgcctaatacatgcaagtcgaacgcactgtggttgaaatgagatgagaagcttgcttcaagtcaaatgccaacattgcagtgagtggcgaacgggtgagtaacacgtgggaaacctacctcttagcaggggataacatctggaaacaggtgctaataccgtataacaataaaaaccgcatggttttgatttaaaagatggttctgctatcactaagagatggtcccgcggtgcattagttagttggtgaggtaaaggctcaccaagacgatgatgcatagccgagttgagagactgatcggccacaatgggactgagacacggcccatactcctacgggaggcagcagtagggaatcttccacaatggacgaaagtctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcggcttaaccgaggaattgctttggaaactggataacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctagctgttcgagggtttccgcccttgagtggcgaagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccactccagagatggagctttcccttcggggacaaagtgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggcggggatgacgtcaaatcatcatgccccttatgacctgggctacacacgtgctacaatggcaagtacaacgagcagccaacccgcgagggtgcgcaaatctcttaaagcttgtctcagttcggactgtaggctgcaactcgcctacacgaagtcggaatcgctagtaatcgcggatcagcacgccgcggtgaatacgttcccgggtcttgtacacaccgcccgtcacaccatgagagtttgtaacacccaaagtcggtgaggtaacctttataggggccagccgcctaaggtgggacagatgattagggtgaagtcgtaacaaggtagccgtaggagaacctgcggctggatcacctcctttctaaggaa

SEQ ID NO: 10033 - DNA, 1590 bp, Weissella koreensis
  ref <308>: DATABASE ACCESSION NUMBER: NCBI ACCESSION: NZ_CP026847.1
  ref <309>: DATABASE ENTRY DATE: 2019-04-01
  ref <313>: RELEVANT RESIDUES IN SEQ ID NO: (1)..(1590)
ttaaattgagagtttgatcctggctcaggatgaacgctggcggcgtgcctaatacatgcaagtcgaacgcattgtggttgaaatgatatgaagaacttgttcagatttgattttcaacattgcaatgagtggcgaacgggtgagtaacacgtgggaaacctacctcttagcaggggataacatttggaaacaaatgctaataccgtataataattaaaaccgcatggttttagtttaaaagatggtcttgctatcactaagagatggtcccgcggtgtattagttagttggtgaggtaatggctcaccaagacaatgatacatagccgagttgagagactgaccggccacaatgggactgagacacggcccatactcctacgggaggcagcagtagggaatcttccacaatggacgaaagtctgatggagcaacgccgcgtgtgtgatgaagggtttcggctcgtaaaacactgttgtaagagaagaatgacattgagagtaactgttcaatgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcggctcaaccgaggaattgctttggaaactggataacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacactgtaaacgatgagtgctagttgttcgagggtttccgcccttgagtgacgaagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgactactccagagatggagctttcccttcggggacaaagtgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggcggggatgacgtcaaatcatcatgccccttatgacctgggctacacacgtgctacaatggcaagtacaacgagtcgccaacccgcgagggtgcgcaaatctcttaaagcttgtctcagttcggactgtaggctgcaactcgcctacacgaagtcggaatcgctagtaatcgcggatcagcacgccgcggtgaatacgttcccgggtcttgtacacaccgcccgtcacaccatgagagtttgtaacacccaaagtcggtgaggtaaccttttattaggagccagccgcctaaggtgggacagatgattagggtgaagtcgtaacaaggtagccgtaggagaacctgcggctggatcacctcctttctaaggaa

SEQ ID NO: 10034 - DNA, 1588 bp, Weissella minor
  ref <308>: DATABASE ACCESSION NUMBER: NCBI ACCESSION: NZ_JQCD01000006.1
  ref <309>: DATABASE ENTRY DATE: 2019-04-01
  ref <313>: RELEVANT RESIDUES IN SEQ ID NO: (1)..(1588)
ttcaaaatgagagtttgatcctggctcaggatgaacgctggcggcgtgcctaatacatgcaagtcgaacgctttgtggttcaactgatatgaagagcttgctcggatttgaagatgaacattgcaaagagtggcgaacgggtgagtaacacgtgggaaacctacctcttagcgggggataacacttggaaacaagtgctaataccgcataatactgataaccgcatggttatcagttgaaagatggttctgctatcactaagagatggtcccgcggtgtattagctagttggtaaggtaatggcttaccaaggcaatgatacatagccgagttgagagactgatcggccacaatgggactgagacacggcccatactcctacgggaggcagcagtagggaatcttccacaatggacgaaagtctgatggagcaacgccgcgtgtgtgatgaagggtttcggctcgtaaaacactgttgtaagagaagaatgacattgagagtaactgttcagtgtgtgacggtatcttaccagaaaggaacggctaaatacgtgccagcagccgcggtaatacgtatgttccaagcgttatccggatttattgggcgtaaagcgagcgcagacggttgtttaagtctgaagtgaaagcccacagcttaactgtggaagtgctttggaaactggataacttgagtgcagtagaggagagtggaactccatgtgtagcggtgaaatgcgtagatatatggaagaacaccagtggcgaaggcggctctctggactgtaactgacgttgaggctcgaaagtgtgggtagcaaacaggattagataccctggtagtccacaccgtaaacgatgagtgctagatgtttgagggtttccgcccttaagtgtcgcagctaacgcattaagcactccgcctggggagtacgaccgcaaggttgaaactcaaaggaattgacggggacccgcacaagcggtggagcatgtggtttaattcgaagcaacgcgaagaaccttaccagctcttgacatcctttgaccacttcagagatgaagctttcccttcggggacaaagtgacaggtggtgcatggttgtcgtcagctcgtgtcgtgagatgttgggttaagtcccgcaacgagcgcaacccttattactagttgccagcatttagttgggcactctagtgagactgccggtgacaaaccggaggaaggtggggatgacgtcaaatcatcatgccccttatgagctgggctacacacgtgctacaatggcaagtacaacgagcagctaacccgcgagggtacgcgaatctcttaaaacttgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtgaggtaaccttttaggagccaaccgtctaaggtgggacagatgattagggtgaagtcgtaacaaggtagccgtaggagaacctgcggctggatcacctcctttctaaggaa

SEQ ID NO: 10035 - DNA, 1562 bp, Weissella oryzae
  ref <308>: DATABASE ACCESSION NUMBER: NCBI ACCESSION: NZ_DF820520.1
  ref <309>: DATABASE ENTRY DATE: 2019-04-01
  ref <313>: RELEVANT RESIDUES IN SEQ ID NO: (1)..(1562)
ttcaaaatgagagtttgatcctggctcaggatgaacgctggcggcgtgcctaatacatgcaagtcgaacgctgattattgaaagcttgcttttaatatgatgagtggcgaacgggtgagtaacacgtgggaaacctacctcttagcaggggataacatttggaaacagatgctaataccgtataaaagttaaaaccgcatggttttaatttaaaagatggttctgctatcactaagagatggtcccgcggtgcattagctagatggtgaggtaacggctcaccatggccatgatgcatagccgagttgagagactgatcggccacaatgggactgagacacggcccatactcctacgggaggcagcagtagggaatcttccacaatgggcgcaagcctgatggagcaacgccgcgtgtgtgatgaagggtttcggctcgtaaagcactgttgtaagagaagaatgacgttgagagtaactgttcaacgtgtgacggtatcttaccagaaagggacggctaaatacgtgccagcagccgcggtaatacgtatgtcccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtggaatgcgtagatatatggaagaacaccagtggcgaaggcggctttctggactgtaactgacgttgaggctcgaaagtgtgggtagcaaacaggattagataccctggtagtccacaccgtaaacgatgagtgctaggtgtttgggggtttccgcccctaagtgccgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgacaactctagagatagagtgttcccttcggggacaaggtgacaggtggtgcatggttgtcgtcagctcgtgtcgtgagatgttgggttaagtcccgcaacgagcgcaacccttattgttagttgccagcatttagttgggcactctagcaagactgccggtgacaaaccggaggaaggcggggatgacgtcaaatcatcatgccccttatgacctgggctacacacgtgctacaatggcgtatacaacgagttgccaacccgcgagggtgagctaatctcttaaagtacgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttttaggagccagccgtctaaggtgggacagatgattagggtgaagtcgtaacaaggtagccgtaggagaacctgcggctggatcacctcctttctaaggaa

SEQ ID NO: 10036 - DNA, 1585 bp, Weissella paramesenteroides
  ref <308>: DATABASE ACCESSION NUMBER: NCBI ACCESSION: NZ_CP023501.1
  ref <309>: DATABASE ENTRY DATE: 2019-04-01
  ref <313>: RELEVANT RESIDUES IN SEQ ID NO: (1)..(1585)
tttaaaatgagagtttgatcctggctcaggatgaacgctggcggcgtgcctaatacatgcaagtcgaacgctttgtctttaattgatctgacgagcttgctctaatttgattttatctgacaaagagtggcgaacgggtgagtaacacgtgggtaacctacctcttagcaggggataacatttggaaacaagtgctaataccgtataataccaacaaccgcatggttgttggttgaaagatggttctgctatcactaagagatggacccgcggtgcattagctagttggtaaggtaaaggcttaccaaggcaatgatgcatagccgagttgagagactgatcggccacaatgggactgagacacggcccatactcctacgggaggcagcagtagggaatcttccacaatgggcgcaagcctgatggagcaacgccgcgtgtgtgatgaagggtttcggctcgtaaaacactgttataagagaagaacggcactgagagtaactgttcagtgtgtgacggtatcttaccagaaaggaacggctaaatacgtgccagcagccgcggtaatacgtatgttccaagcgttatccggatttattgggcgtaaagcgagcgcagacggttatttaagtctgaagtgaaagccctcagctcaactgaggaatggctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctagatgttcgagggtttccgcccttgagtgtcgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgctaatcctagaaataggacgttcccttcggggacaaggtgacaggtggtgcatggttgtcgtcagctcgtgtcgtgagatgttgggttaagtcccgcaacgagcgcaacccttattattagttgccagcatttagttgggcactctagtgagactgccggtgacaaaccggaggaaggtggggatgacgtcaaatcatcatgccccttatgacctgggctacacacgtgctacaatggcatatacaacgagtcgccaacccgcgagggtgcgctaatctcttaaagtatgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtggggtaaccttttaggagccagccgtctaaggtgggacagatgattagggtgaagtcgtaacaaggtagccgtaggagaacctgcggctggatcacctcctttctaaggaa

SEQ ID NO: 10037 - DNA, 1584 bp, Weissella soli
  ref <308>: DATABASE ACCESSION NUMBER: NCBI ACCESSION: NZ_QRAS01000007.1
  ref <309>: DATABASE ENTRY DATE: 2019-04-01
  ref <313>: RELEVANT RESIDUES IN SEQ ID NO: (1)..(1584)
aaattgagagtttgatcctggctcaggatgaacgctggcggcgtgcctaatacatgcaagtcgaacgccttgtggttttaatgaatagcgtgcttgcacaatatgatttaaaacaatgcaaggagtggcgaacgggtgagtaacacgtgggaaacctacctcttagcaggggataacatttggaaacagatgctaataccgtataacactaaaaaccgcatggtttttatttgaaagatggttctgctatcactaagagatggtcccgcggtgcattagttagatggtgaggtaatggctcaccatgacgatgatgcatagccgagttgagagactgatcggccacaatgggactgagacacggcccatactcctacgggaggcagcagtagggaatcttccacaatgggcgcaagcctgatggagcaacgccgcgtgtgtgatgaagggtttcggctcgtaaagcactgttgtaagagaagaatgtacttgagagtaactgttcaagtagtgacggtatcttaccagaaagggacggctaaatacgtgccagcagccgcggtaatacgtatgtcccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacaggattagataccctggtagtccacaccgtaaacgatgagtgctagctgttcgagggtttccgcccttgagtggcgtagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccactccagagatggagctttcccttcggggacaaagtgacaggtggtgcatggttgtcgtcagctcgtgtcgtgagatgttgggttaagtcccgcaacgagcgcaacccttattgttagttgccagcattcagttgggcactctagcgagactgccggtgacaaaccggaggaaggcggggatgacgtcaaatcatcatgccccttatgacctgggctacacacgtgctacaatggcatatacaacgagtcgccaacccgcgagggtgcgctaatctcttaaagtatgtctcagttcggactgtaggctgcaactcgcctacacgaagtcggaatcgctagtaatcgcggatcagcacgccgcggtgaatacgttcccgggtcttgtacacaccgcccgtcacaccatgagagtttgtaacacccaaagtcggtggggtaacctttataggagccagccgcctaaggtgggacagatgattagggtgaagtcgtaacaaggtagccgtaggagaacctgcggctggatcacctcctttctaaggaa

SEQ ID NO: 10038 - DNA, 1508 bp, Weissella thailandensis
  ref <308>: DATABASE ACCESSION NUMBER: NCBI ACCESSION: NZ_QRAY01000033.1
  ref <309>: DATABASE ENTRY DATE: 2019-04-01
  ref <313>: RELEVANT RESIDUES IN SEQ ID NO: (1)..(1508)
tttaattgatatgaagagcttgctctgatttgattttatctgacaaagagtggcgaacgggtgagtaacacgtgggtaacctacctcttagcaggggataacatttggaaacaagtgctaataccgtataacactaacaaccgcatggttgttagttgaaagatggttctgctatcactaagagatggacccgcggtgcattagctagttggtaaggtaatggcttaccaaggcgatgatgcgtagccgagttgagagactgatcggccacaatgggactgagacacggcccatactcctacgggaggcagcagtagggaatcttccacaatgggcgcaagcctgatggagcaacgccgcgtgtgtgatgaagggtttcggctcgtaaaacactgttataagagaagaacgacattgagagtaactgttcagtgtgtgacggtatcttatcagaaaggaacggctaaatacgtgccagcagccgcggtaatacgtatgttccaagcgttatccggatttattgggcgtaaagcgagcgcagacggttatttaagtctgaagtgaaagccctcagctcaactgaggaagggctttggaaactggataacttgagtgcagtagaggaaagtggaactccatgtgtagcggtgaaatgcgtagatatatggaagaacaccggtggcgaaagcggctttctggactgtaactgacgttgaggctcgaaagtgtgggtagcaaacaggattagataccctggtagtccacaccgtaaacgatgagtgctagatgttcgagggtttccgcccttgagtgtcgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcccttgctaatcctagaaataggatgttcccttcggggacaaggtgacaggtggtgcatggttgtcgtcagctcgtgtcgtgagatgttgggttaagtcccgcaacgagcgcaacccttattattagttgccagcattcagttgggcactctagtgagactgccggtgacaaaccggaggaaggtggggatgacgtcaaatcatcatgccccttatgacctgggctacacacgtgctacaatggcatatacaacgagtcgctaacccgcgagggtacgctaatctcttaaagtatgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtgcggtaaccttttaggagccaaccgtctaaggtgggacagatgattagggtgaagtcgtaacaaggtagccgtaggagaacctgcggctggatcacctcctttctaaggaa

SEQ ID NO: 10039 - DNA, 1583 bp, Weissella viridescens
  ref <308>: DATABASE ACCESSION NUMBER: NCBI ACCESSION: NZ_LT907932.1
  ref <309>: DATABASE ENTRY DATE: 2019-04-01
  ref <313>: RELEVANT RESIDUES IN SEQ ID NO: (1)..(1583)
aaaatgagagtttgatcctggctcaggatgaacgctggcggcgtgcctaatacatgcaagtcgaacgctttgtggtccaactgatttgaagagcttgctcagatatgacgatggacattgcaaagagtggcgaacgggtgagtaacacgtgggaaacctacctcttagcaggggataacacttggaaacaagtgctaataccgtataacactaataaccgcatggttattagttaaaagatggtcttgctatcactaagagatggtcccgcggtgtattagctagttggtaaggtaatggcttaccaaggcaatgatacatagccgagttgagagactgatcggccacaatgggactgagacacggcccatactcctacgggaggcagcagtagggaatcttccacaatggacgaaagtctgatggagcaacgccgcgtgtgtgatgaagggtttcggctcgtaaaacactgttgtaagagaagaatgacattgagagtaactgttcagtgtgtgacggtatcttaccagaaaggaacggctaaatacgtgccagcagccgcggtaatacgtatgttccaagcgttatccggatttattgggcgtaaagcgagcgcagacggttatttaagtccgaagtgaaagcccacagcttaactgtggaagtgctttggaaactggataacttgagtgcagtagaggagagtggaactccatgtgtagcggtgaaatgcgtagatatatggaagaacaccagtggcgaaggcggctctctggactgtaactgacgttgaggctcgaaagtgtgggtagcaaacaggattagataccctggtagtccacaccgtaaacgatgagtgctagatgtttgagggtttccgcccttaagtgtcgcagctaacgcattaagcactccgcctggggagtacgaccgcaaggttgaaactcaaaggaattgacggggacccgcacaagcggtggagcatgtggtttaattcgaagcaacgcgaagaaccttaccaggtcttgacatcctttgaccacttcagagatgaagctttcccttcggggacaaagtgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggatgacgtcaaatcatcatgccccttatgacctgggctacacacgtgctacaatggcaagtacaacgagcagctaacccgcgagggtacgcgaatctcttaaaacttgtctcagttcggattgtaggctgcaactcgcctacatgaagtcggaatcgctagtaatcgcggatcagcacgccgcggtgaatacgttcccgggtcttgtacacaccgcccgtcacaccatgagagtttgtaacacccaaagccggtgaggtaaccttttaggagccaaccgtctaaggtgggacagatgattagggtgaagtcgtaacaaggtagccgtaggagaacctgcggctggatcacctcctttctaagg

SEQ ID NO: 10040 - DNA, 1469 bp, Wenxinia marina
  ref <308>: DATABASE ACCESSION NUMBER: NCBI ACCESSION: NZ_KN848371.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcgcgcccttcggggtgagcggcggacgggtgagtaacgcgtgggaatatgcctcttggtacggaatagccactggaaacggtgagtaataccgtatgtgcccttagggggaaagatttatcgccaagagattagcccgcgttggattaggtagttggtggggtaaaggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggtcgtaaagctctttcgccagggaagataatgactgtacctggtaaagaaaccccggctaactccgtgccagcagccgcggtaatacggagggggttagcgttgttcggaattactgggcgtaaagcgcgcgtaggcggaccattaagtcgggggtgaaatcccggggctcaaccccggaactgccctcgatactggcggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggggggcttgcccttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatcccgggaccgctgcagagatgcagtttccacttcggtggctcggtgacaggtgctgcatggctgtcgtcagctcgtgtcgtgagatgttcggttaagtccggcaacgagcgcaacccacatccccagttgccagcattcagttgggcactctggggaaactgcccgtgataagcgggaggaaggtgtggatgacgtcaagtcctcatggcccttacgggttgggctacacacgtgctacaatggctgtgacaatgggttaatcccaaaaagcagtctcagttcggattgtcgtctgcaactcgacggcatgaagtcggaatcgctagtaatcgcgtaacagcatgacgcggtgaatacgttcccgggccttgtacacaccgcccgtcacaccatgggagttggttctacccgaaggtggtgcgccaacctgttcgcagggggcagccaaccacggtaggatcagcgactggggtgaagtcgtaacaaggtagccgtaggggaacctgcggctggatcacctcctttctaa

SEQ ID NO: 10041 - DNA, 1469 bp, Wenxinia saemankumensis
  ref <308>: DATABASE ACCESSION NUMBER: NCBI ACCESSION: NZ_FQYO01000011.1
  ref <309>: DATABASE ENTRY DATE: 2019-04-01
  ref <313>: RELEVANT RESIDUES IN SEQ ID NO: (1)..(1469)
caacttgagagtttgatcctggctcagaacgaacgctggcggcaggcctaacacatgcaagtcgagcgcgcccttcggggtgagcggcggacgggtgagtaacgcgtgggaatatgcctctcggtgcggaatagccactggaaacggtgagtaataccgcatgcgcccttcgggggaaagatttatcgccgagagattagcccgcgttggattaggtagttggtggggtaaaggcctaccaagccgacgatccatagctggtttgagaggatgatcagccacactgggactgagacacggcccagactcctacgggaggcagcagtggggaatcttagacaatgggggcaaccctgatctagccatgccgcgtgagtgatgaaggccttagggtcgtaaagctctttcgccagggaagataatgactgtacctggtaaagaaaccccggctaactccgtgccagcagccgcggtaatacggagggggttagcgttgttcggaattactgggcgtaaagcgcgcgtaggcggaccattaagtcaggggtgaaatcccggggctcaaccccggaactgcccttgatactggcggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcggggggcttgcccttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatccctggaccgctagagagatctagtttccacttcggtggccaggtgacaggtgctgcatggctgtcgtcagctcgtgtcgtgagatgttcggttaagtccggcaacgagcgcaacccacatccccagttgccatcatttggttgggcactctggggaaactgcccgtgataagcgggaggaaggtgtggatgacgtcaagtcctcatggcccttacgggttgggctacacacgtgctacaatggcagtgacaatgggttaatcccaaaaagctgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgaaggtggtgcgccaacctgttcgcaggaggcagccaaccacggtaggatcagcgactggggtgaagtcgtaacaaggtagccgtaggggaacctgcggctggatcacctcctttctaa

SEQ ID NO: 10042 - DNA, 1526 bp, Williamsia marianensis
  ref <308>: DATABASE ACCESSION NUMBER: NCBI ACCESSION: NZ_QEOM01000033.1
  ref <309>: DATABASE ENTRY DATE: 2019-04-01
  ref <313>: RELEVANT RESIDUES IN SEQ ID NO: (1)..(1526)
tttcatggagagtttgatcctggctcaggacgaacgctggcggcgtgcttaacacatgcaagtcgaacgatgaagccagcttgctggtggattagtggcgaacgggtgagtaacacgtgggtgatctgccccaaactttgggataagcctgggaaactgggtctaataccgaatatgaccgatactcgcatgggtgttggtggaaagctccggcggtttgggatgggcccgcggcctatcagcttgttggtggggtaatggcctaccaaggcgacgacgggtagccggcctgagagggcgaccggccacactgggactgagacacggcccagactcctacgggaggcagcagtggggaatattgcacaatgggcgcaagcctgatgcagcgacgccgcgtgagggatgacggccttcgggttgtaaacctctttcaccagggacgaagcgaaagtgacggtacctggagaagaagcaccggccaactacgtgccagcagccgcggtaatacgtagggtgcgagcgttgtccggaattactgggcgtaaagagctcgtaggcggtttgtcgcgtcgttcgtgaaaacttggggcttaactccaagcgtgcgggcgatacgggcagacttgagtactacaggggagactggaattcctggtgtagcggtgaaatgcgcagatatcaggaggaacaccggtggcgaaggcgggtctctgggtagtaactgacgctgaggagcgaaagcgtgggtagcgaacaggattagataccctggtagtccacgccgtaaacggtgggtactaggtgtgggttccttttcacgggatccgtgccgtagctaacgcattaagtaccccgcctggggagtacggccgcaaggctaaaactcaaaggaattgacgggggcccgcacaagcggcggagcatgtggattaattcgatgcaacgcgaagaaccttacctgggtttgacatacaccagaaagccatagagatatggccccccttgtggttggtgtacaggtggtgcatggctgtcgtcagctcgtgtcgtgagatgttgggttaagtcccgcaacgagcgcaacccttgtcctgtgttgccagcacgtaatggtggggactcgcaggagactgccggggtcaactcggaggaaggtggggatgacgtcaagtcatcatgccccttatgtccagggcttcacacatgctacaatggccggtacagagggctgcgataccgtgaggtggagcgaatcccttaaagccggtctcagttcggatcggggtctgcaactcgaccccgtgaagtcggagtcgctagtaatcgcagatcagcaacgctgcggtgaatacgttcccgggccttgtacacaccgcccgtcacgtcatgaaagttggtaacacccgaagccggtggcccaaccccttgtgggagggagccgtcgaaggtgggattggcgattgggacgaagtcgtaacaaggtagccgtaccggaaggtgcggctggatcacctcctttctaa

SEQ ID NO: 10043 - DNA, 1526 bp, Williamsia muralis; identical to SEQ ID NO: 10042
  ref <308>: DATABASE ACCESSION NUMBER: NCBI ACCESSION: NZ_RBKV01000001.1
  ref <309>: DATABASE ENTRY DATE: 2019-04-01
  ref <313>: RELEVANT RESIDUES IN SEQ ID NO: (1)..(1526)

SEQ ID NO: 10044 - DNA, 1503 bp, Wolbachia endosymbiont of Brugia malayi
  ref <308>: DATABASE ACCESSION NUMBER: NCBI ACCESSION: NC_006833.1
  ref <309>: DATABASE ENTRY DATE: 2019-04-01
  ref <313>: RELEVANT RESIDUES IN SEQ ID NO: (1)..(1503)
aaatttgagagtttgatcctggctcagaatgaacgctggcggcaggcctaacacatgcaagttgaacggagttatattataacgagttatagtataactgagtagcagacgggtgagtaatgtataggaatctacctagtagtacggaataattgttggaaacggcaactaataccgtatacgccctacgggggaaagatttattgctattagatgagcctatattagattagctagttggtagggtaatggcctaccaaggcagtaatctatagctgatctgagaggatgatcagccacactggaactgagatacggtccagactcctacgggaggcagcagtggggaatattggacaatgggcgaaagcctgatccagccatgccgcatgagtgaagaaggcctttgggttgtaaagctctttcagtgaggaagataatgacggtactcacagaagaagtcctggctaactccgtgccagcagccgcggtaatacggagagggctagcgttattcggaattattgggcgtaaagggcgcgtaggctgattagtaagttaaaagtgaaatcccaaagcttaactttggaattgcttttaaaactgttaatctagaggttgaaagaggatagaggaattcctagtgtagaggtgatattcgtaaatattaggaggaacaccagtggcgaaggcgtctatctggttcaaatctgacgctgaggcgcgaaggcgtggggagcaaacaggattagataccctggtagtccacgctgtaaacgatgaatgttaaatatgggaagtttactttctgtattacagctaacgcgttaaacattccgcctggggactacgatcgcaagattaaaactcaaaggaattgacggggacccgcacaagcggtggagcatgtggtttaattcgatgcaacgcgaaaaaccttaccactccttgacatgggaattattcctattcgaaggaatagggtcggttcggccgaatttcacacaggtgttgcatggctgtcgtcagctcgtgtcgtgagatgttgggttaagtcccgcaacgagcgtaaccctcatccttagttaccatcaggtaatgctggggactttaaggaaactgctagtgataaactggaggaaggtggggatgatgtcaagtcatcatggcccttatggagtgggctacacacgtgctacaatggtggctacaatgggctgcaaagtcgcgaggccaagctaatcccttaaaagccatctcagttcggattgtactctgcaactcgagtgcatgaagttggaatcgctagtaatcgtggatcagcatgccacggtgaatacgttctcgggtcttgtacacactgcccgtcacgccatgggaattggtttcactcgaagctaatgacctaaccgtaaggagggagttatttaaagtgggatcagtgactggggtgaagtcgtaacaaggtagcagtaggggaatctgcagctggattacctcctt

SEQ ID NO: 10045 - DNA, 1504 bp, Wolbachia endosymbiont of Cimex lectularius
  ref <308>: DATABASE ACCESSION NUMBER: NCBI ACCESSION: NZ_AP013028.1
  ref <309>: DATABASE ENTRY DATE: 2019-04-01
  ref <313>: RELEVANT RESIDUES IN SEQ ID NO: (1)..(1504)
aaatttgagagtttgatcctggctcagaatgaacgctggcggcaggcttaacacatgcaagtcgaacggggttatattgtagcttgctatggtataacttagtggcagacgggtgagtaatgtataggaatctacctagtagtacggaataattgttggaaacggcaactaataccgtatacgccctaagggggaaagatttattgctattagatgagcctatattagattagttagttggtaaggtaatggcttaccaaggcaatgatctatagctgatctgagaggatgatcagccacactggaactgagatacggtccagactcctacgggaggcagcagtggggaatattggacaatgggcgaaagcctgatccagccataccgcatgagtgaagaaggcctttgggttgtaaagctctttcggtgaggaagatagtgacggtactcacagaagaagtcctggctaactccgtgccagcagccgcggtaatacggagagggctagcgttattcggaattattgggcgtaaagagcgcgtaggctggttagtaagttaaaagtgaaatcccaaagctcaactttggaattgcttttaaaactgctaacctagagattgaaagaggatagaggaattcctagtgtagaggtgaaattcgtaaatattaggaggaacaccagtggcgaaggcgtctatctggttcaaatctgacgctgaggcgcgaaggcgtggggagcaaacaggattagataccctggtagtccacgctgtaaacgatgaatgttaaatatgggaagtttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccactccttgacatggaaatcatacctattcgaagggatagggtcggttcggccggatttcacacaggtgttgcatggctgtcgtcagctcgtgtcgtgagatgttgggttaagtcccgcaacgagcgtaaccctcatccttagttaccatcgggtaatgctggggactttaaggaaactgctagtgataaactggaggaaggtggggatgatgtcaagtcatcatggcctttatggagtgggctacacacgtgctacaatggtggctacaatgggctgcaaagtcgcgaggctaagctaatctcttaaaagccatctcagttcggattgtactctgcaactcgagtgcatgaagttggaatcgctagtaatcgtggatcagcatgccacggtgaatacgttctcgggtcttgtacacactgcccgtcacgccatgggaattggtttcactcgaagctaatgacctaaccgcaaggagggagttatttaaagtgggatcagtgactggggtgaagtcgtaacaaggtagcagtaggggaatctgcagctggattacctcctta

SEQ ID NO: 10046 - DNA, 1504 bp, Wolbachia endosymbiont of Culex pipiens molestus
  ref <308>: DATABASE ACCESSION NUMBER: NCBI ACCESSION: NZ_CACK01000089.1
  ref <309>: DATABASE ENTRY DATE: 2019-04-01
  ref <313>: RELEVANT RESIDUES IN SEQ ID NO: (1)..(1504)
aaatttgagagtttgatcctggctcagaatgaacgctggcggcaggcctaacacatgcaagtcgaacggagttatattgtagcttgctatggtataacttagtggcagacgggtgagtaatgtataggaatctacctagtagtacggaataattgttggaaacgacaactaataccgtatacgccctacgggggaaaaatttattgctattagatgagcctatattagattagctagttggtggggtaatagcctaccaaggtaatgatctatagctgatctgagaggatgatcagccacactggaactgagatacggtccagactcctacgggaggcagcagtggggaatattggacaatgggcgaaagcctgatccagccatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggctggttaataagttaaaagtgaaatcccgaggcttaaccttggaattgcttttaaaactattaatctagagattgaaagaggatagaggaattcctgatgtagaggtaaaattcgtaaatattaggaggaacaccagtggcgaaggcgtctatctggttcaaatctgacgctgaagcgcgaaggcgtggggagcaaacaggattagataccctggtagtccacgctgtaaacgatgaatgttaaatatggggagtttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccacttcttgacatgaaaatcatacctattcgaagggatagggtcggttcggccggattttacacaagtgttgcatggctgtcgtcagctcgtgtcgtgagatgttgggttaagtcccgcaacgagcgcaaccctcatccttagttgccatcaggtaatgctgagtactttaaggaaactgccagtgataagctggaggaaggtggggatgatgtcaagtcatcatggcctttatggagtgggctacacacgtgctacaatggtgtctacaatgggctgcaaggtgcgcaagcctaagctaatccctaaaagacatctcagttcggattgtactctgcaactcgagtacatgaagttggaatcgctagtaatcgtggatcagcatgccacggtgaatacgttctcgggtcttgtacacactgcccgtcacgccatgggaattggtttcactcgaagctaatggcctaaccgcaaggaaggagttatttaaagtgggatcagtgactggggtgaagtcgtaacaaggtagcagtaggggaatctgcagctggattacctcctta

SEQ ID NO: 10047 - DNA, 1504 bp, Wolbachia endosymbiont of Culex quinquefasciatus; identical to SEQ ID NO: 10046
  ref <308>: DATABASE ACCESSION NUMBER: NCBI ACCESSION: NZ_DS996942.1
  ref <309>: DATABASE ENTRY DATE: 2019-04-01
  ref <313>: RELEVANT RESIDUES IN SEQ ID NO: (1)..(1504)

SEQ ID NO: 10048 - DNA, 850 bp, Wolbachia endosymbiont of Dactylopius coccus
  ref <308>: DATABASE ACCESSION NUMBER: NCBI ACCESSION: NZ_LSYX01000109.1
  ref <309>: DATABASE ENTRY DATE: 2019-04-01
  ref <313>: RELEVANT RESIDUES IN SEQ ID NO: (1)..(850)
aaattcgtaaatattaggaggaacaccagtggcgaaggcgtctatctggttcaaatctgacgctgaagcgcgaaggcgtggggagcaaacaggattagataccctggtagtccacgctgtaaacgatgaatgttaaatatgggaagtttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccacttcttgacatggaaatcatacctattcgaagggatagggtcggttcggccggattttacacaagtgttgcatggctgtcgtcagctcgtgtcgtgagatgttgggttaagtcccgcaacgagcgcaaccctcatccttagttaccatcaggtaatgctggggactttaaggaaactgccagtgataaactggaggaaggtggggatgatgtcaagtcatcatggcccttatggagtgggctacacacgtgctacaatggtggctacaatgggctgcaaagtcgcgaggctaagccaatcccttaaaagccatctcagttcggattgtactctgcaactcgagtgcatgaagttggaatcgctagtaatcgtggatcagcacgccacggtgaatacgttctcgggtcttgtacacactgcccgtcacgccatgggaattggtttcactcgaagctaacgacctaaccgcaaggagggagttatttaaagtgggatcggtgactggggtgaagtcgtaacaaggtagcagtaggggaatctgcagctggattacctcctta

SEQ ID NO: 10049 - DNA, 1504 bp, Wolbachia endosymbiont of Diaphorina citri
  ref <308>: DATABASE ACCESSION NUMBER: NCBI ACCESSION: NZ_KB223536.1
  ref <309>: DATABASE ENTRY DATE: 2019-04-01
  ref <313>: RELEVANT RESIDUES IN SEQ ID NO: (1)..(1504)
aaatttgagagtttgatcctggctcagaatgaacgctggcggcaggcctaacacatgcaagtcgaacggagttatattgtagcttgctatggtataacttagtggcagacgggtgagtaatgtataggaatctacctagtagtacggaataattgttggaaacggcaactaataccgtatacgccctacgggggaaaaatttattgctattagatgagcctatattagattagctagttggtggagtaatagcctaccaaggcaatgatctatagctgatctgagaggatgatcagccacactggaactgagatacggtccagactcctacgggaggcagcagtggggaatattggacaatgggcgaaagcctgatccagctatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggctgattaataagttaaaagtgaaatcccgaggcttaaccttggaattgcttttaaaactattaatctagagattgaaagaggatagaggaattcctgatgtagaggtaaaattcgtaaatattaggaggaacaccagtggcgaaggcgtctatctggttcaaatctgacgctgaggcgcgaaggcgtggggagcaaacaggattagataccctggtagtccacgctgtaaacgatgaatgttaaatatgggaagtttactttctgtattatagctaacgcgttaaacattccgcctggggactacggtcgcaagattaaaactcaaaggaattgacggggacccgcacaagcggtggagcatgtggtttaattcgatgcaacgcgaaaaaccttaccacttcttgacatggaaatcatacctattcgaagggatagggtcggttcggccggatttcacacaggtgttgcatggctgtcgtcagctcgtgtcgtgagatgttgggttaagtcccgcaacgagcgcaaccctcatccttagttgccatcaggtaatgctgagcactttaaggaaactgccagtgataagctggaggaaggtggggatgatgtcaagtcatcatggcctttatggagtgggctacacacgtgctacaatggtgtctacaatgggttgcaaggtgcgcaagcccaagctaatccctaaaagacatctcagttcggattgtactctgcaactcgagtacatgaagttggaatcgctagtaatcgtggatcagcatgccacggtgaatacgttctcgggtcttgtacacactgcccgtcacgccatgggaattggtttcactcgaagctaatggcctaaccgcaaggaaggagttatttaaagtgggatcagtgactggggtgaagtcgtaacaaggtagcagtaggggaatctgcagctggattacctcctta

SEQ ID NO: 10050 - DNA, 1505 bp, Wolbachia endosymbiont of Drosophila ananassae
  ref <308>: DATABASE ACCESSION NUMBER: NCBI ACCESSION: NZ_NSDS01000109.1
  ref <309>: DATABASE ENTRY DATE: 2019-04-01
  ref <313>: RELEVANT RESIDUES IN SEQ ID NO: (1)..(1505)
aaatttgagagtttgatcctggctcagaatgaacgctggcggcaggcctaacacatgcaagtcgaacggagttatattgtagcttgctatggtataacttagtggcagacgggtgagtaatgtataggaatctacctagtagtacggaataattgttggaaacggcaactaataccgtatacgccctacgggggaaaaatttattgctattagatgagcctatattagattagctagttggtggagtaatagcctaccaaggcaatgatctatagctgatctgagaggatgatcagccacactggaactgagatacggtccagactcctacgggaggcagcagtggggaatattggacaatgggcgaaagcctgatccagccatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggcggattagtaagttaaaagtgaaatcccaaggctcaaccttggaattgcttttaaaactgctaatctagagattgaaagaggatagaggaattcctagtgtagaggtgaaattcgtaaatattaggaggaacaccagtggcgaaggcgtctatctggttcaaatctgacgctgaggcgcgaaggcgtggggagcaaacaggattagataccctggtagtccacgctgtaaacgatgaatgttaaatatgggaagttttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccactccttgacatggaaattatacctattcgaagggatagggtcggttcggccgggtttcacacaggtgttgcatggctgtcgtcagctcgtgtcgtgagatgttgggttaagtcccgcaacgagcgcaaccctcatccttagttaccatcaggtaatgctggggactttaaggaaactgccagtgataaactggaggaaggtggggatgatgtcaagtcatcatggcccttatggagtgggctacacacgtgctacaatggtggctacaatgggctgcaaagtcgcgaggctaagctaatcccttaaaagccatctcagttcggattgtactctgcaactcgagtgcatgaagttggaatcgctagtaatcgtggatcagcacgccacggtgaatacgttctcgggtcttgtacacactgcccgtcacgccatgggaattggtttcactcgaagctaacgacctaaccgcaaggagggagttatttaaagtgggatcggtgactggggtgaagtcgtaacaaggtagcagtaggggaatctgcagctggattacctcctta

SEQ ID NO: 10051 - DNA, 1505 bp, Wolbachia endosymbiont of Drosophila incompta
  ref <308>: DATABASE ACCESSION NUMBER: NCBI ACCESSION: NZ_CP011148.1
  ref <309>: DATABASE ENTRY DATE: 2019-04-01
  ref <313>: RELEVANT RESIDUES IN SEQ ID NO: (1)..(1505)
aaatttgagagtttgatcctagctcagaatgaacgctggcggcaggcctaacacatgcaagtcgaacggagttatattgtagcttgctatggtataacttagtggcagacgggtgagtaatgtataggaatctacctagtagtacggaataattgttggaaacggcaactaataccgtatacgccctacgggggaaaaatttattgctattagatgagcctatattagattagctagttggtggagtaatagcctaccaaggcaatgatctatagctgatctgagaggatgatcagccacactggaactgagatacggtccagactcctacgggaggcagcagtggggaatattggacaatgggcgaaagcctgatccagccatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggcggattagtaagttaaaagtgaaatcccaaggctcaaccttggaattgcttttaaaactgctaatctagagattgaaagaggatagaggaattcctagtgtagaggtgaaattcgtaaatattaggaggaacaccagtggcgaaggcgtctatctggttcaaatctgacgctgaggcgcgaaggcgtggggagcaaacaggattagataccctggtagtccacgctgtaaacgatgaatgttaaatatgggaagttttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccactccttgacatggaaattatacctattcgaagggatagggtcggttcggccgggtttcacacaggtgttgcatggctgtcgtcagctcgtgtcgtgagatgttgggttaagtcccgcaacgagcgcaaccctcatccttagttaccatcaggtaatgctggggactttaaggaaactgccagtgataaactggaggaaggtggggatgatgtcaagtcatcatggcccttatggagtgggctacacacgtgctacaatggtggctacaatgggctgcaaagtcgcgaggctaagctaatcccttaaaagccatctcagttcggattgtactctgcaactcgagtgcatgaagttggaatcgctagtaatcgtggatcagcacgccacggtgaatacgttctcgggtcttgtacacactgcccgtcacgccatgggaattggtttcactcgaagctaacgacctaaccgcaaggagggagttatttaaagtgggatcggtgactggggtgaagtcgtaacaaggtagcagtaggggaatctgcagctggattacctcctta

SEQ ID NO: 10052 - DNA, 1505 bp, Wolbachia endosymbiont of Drosophila melanogaster
  ref <308>: DATABASE ACCESSION NUMBER: NCBI ACCESSION: NZ_KI440883.1
  ref <309>: DATABASE ENTRY DATE: 2019-04-01
  ref <313>: RELEVANT RESIDUES IN SEQ ID NO: (1)..(1505)
aaatttgagagtttgatcctagctcagaatgaacgctggcggcaggcctaacacatgcaagtcgaacggagttatattgtagcttgctatggtataacttagtggcagacgggtgagtaatgtataggaatctacctagtagtacggaataattgttggaaacggcaactaataccgtatacgccctacgggggaaaaatttattgctattagatgagcctatattagattagctagttggtggagtaatagcctaccaaggcaatgatctatagctgatctgagaggatgatcagccacactggaactgagatacggtccagactcctacgggaggcagcagtggggaatattggacaatgggcgaaagcctgatccagccatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggcggattagtaagttaaaagtgaaatcccaaggctcaaccttggaattgcttttaaaactgctaatctagagattgaaagaggatagaggaattcctagtgtagaggtgaaattcgtaaatattaggaggaacaccagtggcgaaggcgtctatctggttcaaatctgacgctgaggcgcgaaggcgtggggagcaaacaggattagataccctggtagtccacgctgtaaacgatgaatgttaaatatgggaagttttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccactccttgacatggaaattatacctattcgaagggatagggtcggttcgtccgggtttcacacaggtgttgcatggctgtcgtcagctcgtgtcgtgagatgttgggttaagtcccgcaacgagcgcaaccctcatccttagttaccatcaggtaatgctggggactttaaggaaactgccagtgataaactggaggaaggtggggatgatgtcaagtcatcatggcccttatggagtgggctacacacgtgctacaatggtggctacaatgggctgcaaagtcgcgaggctaagctaatcccttaaaagccatctcagttcggattgtactctgcaactcgagtgcatgaagttggaatcgctagtaatcgtggatcagcacgccacggtgaatacgttctcgggtcttgtacacactgcccgtcacgccatgggaattggtttcactcgaagctaacgacctaaccgcaaggagggagttatttaaagtgggatcggtgactggggtgaagtcgtaacaaggtagcagtaggggaatctgcagctggattacctcctta

SEQ ID NO: 10053 - DNA, 1505 bp, Wolbachia endosymbiont of Drosophila suzukii; identical to SEQ ID NO: 10050
  ref <308>: DATABASE ACCESSION NUMBER: NCBI ACCESSION: NZ_CAOU02000038.1
  ref <309>: DATABASE ENTRY DATE: 2019-04-01
  ref <313>: RELEVANT RESIDUES IN SEQ ID NO: (1)..(1505)

SEQ ID NO: 10054 - DNA, 1504 bp, Wolbachia endosymbiont of Folsomia candida
  ref <308>: DATABASE ACCESSION NUMBER: NCBI ACCESSION: NZ_CP015510.2
  ref <309>: DATABASE ENTRY DATE: 2019-04-01
  ref <313>: RELEVANT RESIDUES IN SEQ ID NO: (1)..(1504)
aaatttgagagtttgatcctggctcagaatgaacgctggcggcaggcctaacacatgcaagtcgaacggagttatattgtagcttgctatggtataacttagtggcagacgggtgagtaatgtataggaatctacctagtagtacggaataattgctggaaacggcaactaataccgtatacgccctacgggggaaaaatttattgctattagatgagcctatattagattagcttgttggtggggtaatggcctaccaaggcaatgatctatagctgatctgagaggatgatcagccacactggaactgagatacggtccagactcctacgggaggcagcagtggggaatattggacaatgggcgaaagcctgatccagccatgccgcatgagtgaagaaggccttcgggttgtaaagctcttttagtgaggaagataatgacggtactcacagaagaagtcctggctaactccgtgccagcagccgcggtaatacggagagggctagcgttattcggaatcattgggcgtaaagggcgcgtaggcggattggtaagttaaaagtgaaatcccaaggctcaaccttggaattgcttttaaaactgctagtctagagattgaaagaggatagaggaattcctagtgtagaggtgaaattcgtaaatattaggaggaacaccagtggcgaaggcgtctatctggttcaaatctgacgctgaggcgcgaaggcgtggggagcaaacaggattagataccctggtagtccacgctgtaaacgatgaatgttaaatatgggaagtttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccacttcttgacatggaaattatacctattcgaagggatagggtcggttcggccgggtttcacacaggtgttgcatggctgtcgtcagctcgtgtcgtgagatgttgggttaagtcccgcaacgagcgcaaccctcatccttagttaccatcaggtaatgctggggactttaaggaaactgctagtgataaactggaggaaggtggggatgatgtcaagtcatcatggcccttatgaagtgggctacacacgtgctacaatggtggctacaatgggctgcaaagtcgcgaggctaagctaatcccttaaaagccatctcagttcgaattgcactctgcaactcgagtgcatgaagttggaatcgctagtaatcgtggatcagcatgccacggtgaatacgttctcgggtcttgtacacactgcccgtcacgccatgggaattggtttcactcgaagctaacgacctaaccgcaaggagggagttatttaaagtgggatcggtgactggggtgaagtcgtaacaaggtagcggtaggggaatctgcagctggattacctcctta

SEQ ID NO: 10055 - DNA, 1505 bp, Wolbachia endosymbiont of Glossina morsitans morsitans
  ref <308>: DATABASE ACCESSION NUMBER: NCBI ACCESSION: NZ_AWUH01000049.1
  ref <309>: DATABASE ENTRY DATE: 2019-04-01
  ref <313>: RELEVANT RESIDUES IN SEQ ID NO: (1)..(1505)
aaatttgagagtttgatcctggctcagaatgaacgctggcggcaggcctaacacatgcaagtcgaacggagttatattgtggcttgctatggtataacttagtggcagacgggtgagtaatgtataggaatctacctaatagtacggaataattgttggaaacggcaactaataccgtatacgccctacgggggaaaaatttattgctattagatgagcctatattagattagctagttggtggagtaatagcctaccaaggcaatgatctatagctgatctgagaggatgatcagccacactggaactgagatacggtccagactcctacgggaggcagcagtggggagtattggacaatgggcgaaagcctgatccagccatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggcggattggtaagttaaaagtgaaatcccaaggctcaaccttggaattgcttttaaaactgctaatctagagattgaaagaggatagaggaattcctagtgtagaggtgaaattcgtaaatattaggaggaacaccagtggcgaaggcgtctatctggttcaaatctgacgctgaggcgcgaaggcgtggggagcaaacaggattagataccctggtagtccacgctgtaaacggtgaatgttaaatatgggaagttttgctttctgtattacagctaacgcgttaaacattccgcctggggactacggtcgcaagattaaaactcaaaggaattgacggggacccgcacaagcggtggagcatgtggtttaattcgatgcaacgcgaaaaaccttaccactccttgacatggaaattatacctattcgaagggatagggtcggttcggccgggtttcacacaggtgttgcatggctgtcgtcagctcgtgtcgtgagatgttgggttaagtcccgcaacgagcgcaaccctcatccttagttaccatcaggtaatgctggggactttaaggaaactgccagtgataaactggaggaaggtggggatgatgtcaagtcatcatggcccttatggagtgggctacacacgtgctacaatggtggctacaatgggctgcaaagtcgcgaggctaagctaatcccttaaaagccatctcagttcggattgtactctgcaactcgagtgcatgaagttggaatcgctagtaatcgtggatcagcacgccacggtgaatacgttttcgggtcttgtacacactgcccgtcacgccatgggaattggttttactcgaagctaacgacctaaccgcaaggagggagttatttaaagtgggatcggtgactggggtgaagtcgtaacaaggtagcagtaggggaatctgcagctggattacctcctta

SEQ ID NO: 10056 - DNA, 1504 bp, Wolbachia endosymbiont of Laodelphax striatella
  ref <308>: DATABASE ACCESSION NUMBER: NCBI ACCESSION: NZ_LRUH01000048.1
  ref <309>: DATABASE ENTRY DATE: 2019-04-01
  ref <313>: RELEVANT RESIDUES IN SEQ ID NO: (1)..(1504)
aaatttgagagtttgatcctggctcagaatgaacgctggcggcaggcctaacacatgcaagtcgaacggagttatattgtagcttgctatggtataacttagtggcagacgggtgagtaatgtataggaatctacctagtagtacggaataattgttggaaacggcaactaataccgtatacgccctacgggggaaaaatttattgctattagatgagcctatattagattagctagttggtggagtaatagcctaccaaggcaatgatctatagctgatctgagaggatgatcagccacactggaactgagatacggtccagactcctacgggaggcagcagtggggaatattggacaatgggcgaaagcctgatccagccatgccgcatgagtgaagaaggcctttgggttgtaaagctcttttagtgagggagataatgacggtactcacagaagaagtcctggctaactccgtgccagcagccgcggtaatacggagagggctagcgttattcggaattattgggcgtaaagggcgcgtaggctggttaataagttaaaagtgaaatcccgaggcttaaccttggaattgcttttaaaactattaatctagagattgaaagaggatagaggaattcctgatgtagaggtaaaattcgtaaatattaggaggaacaccagtggcgaaggcgtctatctggttcaaatctgacgctgaggcgcgaaggcgtggggagcaaacaggattagataccctggtagtccacgctgtaaacgatgaatgttaaatatgggaagtttactttctgtattatagctaacgcgttaaacattccgcctggggactacggtcgcaagattaaaactcaaaggaattgacggggacccgcacaagcggtggagcatgtggtttaattcgatgcaacgcgaaaaaccttaccacttcttgacatggaaatcatacctattcgaagggatagggtcggttcggccggatttcacacaggtgttgcatggctgtcgtcagctcgtgtcgtgagatgttgggttaagtcccgcaacgagcgcaaccctcatccttagttgccatcaggtaatgctgagcactttaaggaaactgccagtgataagctggaggaaggtggggatgatgtcaagtcatcatggcctttatggagtgggctacacacgtgctacaatggtgtctacaatgggttgcaaggtgcgcaagcccaagctaatccctaaaagacatctcagttcggattgtactctgcaactcgagtacatgaagttggaatcgctagtaatcgtggatcagcatgccacggtgaatacgttctcgggtcttgtacacactgcccgtcacgccatgggaattggtttcactcgaagctaatggcctaaccgcaaggaaggagttatttaaagtgggatcagtgactggggtgaagtcgtaacaaggtagcagtaggggaatctgcagctggattacctcctta

SEQ ID NO: 10057 - DNA, 1505 bp, Wolbachia endosymbiont of Nomada ferruginata
  ref <308>: DATABASE ACCESSION NUMBER: NCBI ACCESSION: NZ_LYUY01000076.1
  ref <309>: DATABASE ENTRY DATE: 2019-04-01
  ref <313>: RELEVANT RESIDUES IN SEQ ID NO: (1)..(1505)
aaatttgagagtttgatcctggctcagaatgaacgctggcggcaggcctaacacatgcaagtcgaacggagttatattgtagcttgctatggtataacttagtggcagacgggtgagtaatgtataggaatctacctagtagtacggaataattgttggaaacggcaactaataccgtatacgccctacgggggaaaaatttattgctattagatgagcctatattagattagctagttggtggagtaatagcctaccaaggcaatgatctatagctgatctgagaagatgatcagccacactggaactgagatacggtccagactcctacgggaggcagcagtggggaatattggacaatgggcgaaagcctgatccagccatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggcggattagtaagttaaaagtgaaatcccaaggctcaaccttggaattgcttttaaaactgctaatctagagattgaaagaggatagaggaattcctagtgtagaggtgaaattcgtaaatattaggaggaacaccagtggcgaaggcgtctatctggttcaaatctgacgctgaggcgcgaaggcgtggggagcaaacaggattagataccctggtagtccacgctgtaaacgatgaatgttaaatatgggaagttttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccactccttgacatggaaattatacctattcgaagagatagggtcggttcggccgggtttcacacaggtgttgcatggctgtcgtcagctcgtgtcgtgagatgttgggttaagtcccgcaacgagcgcaaccctcatccttagttaccatcaggtaatgctggggactttaaggaaactgccagtgataaactggaggaaggtggggatgatgtcaagtcatcatggcccttatggagtgggctacacacgtgctacaatggtggctacaatgggctgcaaagtcgcgaggctaagccaatcccttaaaagccatctcagttcggattgtactctgcaactcgagtgcatgaagttggaatcgctagtaatcgtggatcagcacgccacggtgaatacgttctcgggtcttgtacacactgcccgtcacgccatgggaattggtttcactcgaagctaacgacctaaccgcaaggagggagttatttaaagtgggatcggtgactggggtgaagtcgtaacaaggtagcagtaggggaatctgcagctggattacctcctta

SEQ ID NO: 10058 - DNA, 1505 bp, Wolbachia endosymbiont of Nomada flava; identical to SEQ ID NO: 10057
  ref <308>: DATABASE ACCESSION NUMBER: NCBI ACCESSION: NZ_LYUW01000079.1
  ref <309>: DATABASE ENTRY DATE: 2019-04-01
  ref <313>: RELEVANT RESIDUES IN SEQ ID NO: (1)..(1505)

SEQ ID NO: 10059 - DNA, 1505 bp, Wolbachia endosymbiont of Nomada leucophthalma; identical to SEQ ID NO: 10057
  ref <308>: DATABASE ACCESSION NUMBER: NCBI ACCESSION: NZ_LYUV01000078.1
  ref <309>: DATABASE ENTRY DATE: 2019-04-01
  ref <313>: RELEVANT RESIDUES IN SEQ ID NO: (1)..(1505)

SEQ ID NO: 10060 - DNA, 1505 bp, Wolbachia endosymbiont of Nomada panzeri; identical to SEQ ID NO: 10057
  ref <308>: DATABASE ACCESSION NUMBER: NCBI ACCESSION: NZ_LYUX01000081.1
  ref <309>: DATABASE ENTRY DATE: 2019-04-01
  ref <313>: RELEVANT RESIDUES IN SEQ ID NO: (1)..(1505)

SEQ ID NO: 10061 - DNA, 1504 bp, Wolbachia endosymbiont of Onchocerca ochengi
  ref <308>: DATABASE ACCESSION NUMBER: NCBI ACCESSION: NC_018267.1
  ref <309>: DATABASE ENTRY DATE: 2019-04-01
  ref <313>: RELEVANT RESIDUES IN SEQ ID NO: (1)..(1504)
aaatttgagagtttgatcctggctcagaatgaacgctggcggcaggcctaacacatgcaagtcgaacggagttatggtatagcttgctatagtataacttagtggcagacgggtgagtaatgtataggaatctacctagtagtacggaacaattgctggaaacgacaactaataccgtatacgccctacgggggaaagatttattgctattagatgagcctatattagattagctagttggtagggtaatggcctgccaaggctatgatctatagctgatctgagaggatggtcagccacactggaactgagatacggtccagactcctacgggaggcagcagtggggaatattggacaatgggcgaaagcttgatccagccatgccgcgtgagtgaagaaggcctttgggttgtaaagctctttcagtgaggaagataatgacggtactcacagaagaagtcctggctaactccgtgccagcagccgcggtaatacggagagggctagcgttattcggaattattgggcgtaaagagcacgtaggctggttagtaagttaaaagtgaaattccaaagcttaactttggaattgcttttaaaactgctgatctagaggttgaaagaggatagaggaattcctagtgtagaggtgaaattcgtaaatattaggaggaacaccagtggcgaaggcgtctatctggttcaaatctgacgctgaggtgcgaaagcgtggggagcaaacaggattagataccctggtagtccacgctgtaaacgatgaatgttaaatatggggagattactttctgtgttacagctaacgcgttaaacattccgcctggggactacggtcgcaagattaaaactcaaaggaattgacggggacccgcacaagcggtggagcatgtggtttaattcgatgcaacgcgaaaaaccttaccactccttgacatggaaattatatctattcgaagggatagagtcggttcggccgggtttcacacaggtgttgcatggctgtcgtcagctcgtgtcgtgagatgttaggttaagtcccgcaacgagcgtaaccctcatccttagttaccatcaggtaatgctggggactttaaggaaactgccagtgataaactggaggaaggtggggatgacgtcaagtcatcatggcccttatggagtgggctacacacgtgctacaatggtggctacaatgggctgcaaagtcgtgaggctaagctaatcccttaaaagccatctcagttcggattgcactctgcaactcgagtgtatgaagttggaatcgctagtaatcgtggatcagcatgccacggtgaatacgttctcgggtcttgtacacactgcccgtcacgccatgggaattggtttcactcgaagctaatgacctaaccgtaaggaaggagttatttaaagtgggatcagtgactggggtgaagtcgtaacaaggtagcagtaggggaatctgcagctggattacctcctta

SEQ ID NO: 10062 - DNA, 1504 bp, Wolbachia endosymbiont of Onchocerca volvulus
  ref <308>: DATABASE ACCESSION NUMBER: NCBI ACCESSION: NZ_HG810405.1
  ref <309>: DATABASE ENTRY DATE: 2019-04-01
  ref <313>: RELEVANT RESIDUES IN SEQ ID NO: (1)..(1504)
aaatttgagagtttgatcctggctcagaatgaacgctggcggcaggcctaacacatgcaagtcgaacggagttatggtatagcttgctatagtataacttagtggcagacgggtgagtaatgtataggaatctacctagtagtacggaacaattgctggaaacgacaactaataccgtatacgccctacgggggaaagatttattgctattggatgagcctatattagattagctagttggtagggtaatggcctgccaaggctatgatctatagctgatctgagaggatggtcagccacactggaactgagatacggtccagactcctacgggaggcagcagtggggaatattggacaatgggcgaaagcttgatccagccatgccgcgtgagtgaagaaggcctttgggttgtaaagctctttcagtgaggaagataatgacggtactcacagaagaagtcctggctaactccgtgccagcagccgcggtaatacggagagggctagcgttattcggaattattgggcgtaaagagcacgtaggctggttagtaagttaaaagtgaaattccaaagcttaactttggaattgcttttaaaactgctgatctagaggttgaaagaggatagaggaattcctagtgtagaggtgaaattcgtaaatattaggaggaacaccagtggcgaaggcgtctatctggttcaaatctgacgctgaggtgcgaaagcgtggggagcaaacaggattagataccctggtagtccacgctgtaaacgatgaatgttaaatatggggagattactttctgtgttacagctaacgcgttaaacattccgcctggggactacggtcgcaagattaaaactcaaaggaattgacggggacccgcacaagcggtggagcatgtggtttaattcgatgcaacgcgaaaaaccttaccactccttgacatggaaattatatctatccgaagggatagagtcggttcggccgggtttcacacaggtgttgcatggctgtcgtcagctcgtgtcgtgagatgttaggttaagtcccgcaacgagcgtaaccctcatccttagttaccatcaggtaatgctggggactttaaggaaactgccagtgataaactggaggaaggtggggatgacgtcaagtcatcatggcccttatggagtgggctacacacgtgctacaatggtggctacaatgggctgcaaagtcgtgaggctaagctaatcccttaaaagccatctcagttcggattgcactctgcaactcgagtgtatgaagttggaatcgctagtaatcgtggatcagcatgccacggtgaatacgttctcgggtcttgtacacactgcccgtcacgccatgggaattggtttcactcgaagctaatgacctaaccgtaaggaaggagttatttaaagtgggatcagtgactggggtgaagtcgtaacaaggtagcagtaggggaatctgcagctggattacctcctta

SEQ ID NO: 10063 - DNA, 1504 bp, Wolbachia endosymbiont of Operophtera brumata
  ref <308>: DATABASE ACCESSION NUMBER: NCBI ACCESSION: NZ_JYPC01000003.1
  ref <309>: DATABASE ENTRY DATE: 2019-04-01
  ref <313>: RELEVANT RESIDUES IN SEQ ID NO: (1)..(1504)
aaatttgagagtttgatcctggctcagaatgaacgctggcggcaggcctaacacatgcaagtcgaacggagttatattgtagcttgctatggtataacttagtggcagacgggtgagtaatgtataggaatctacctagtagtatggaataattgttggaaacggcaactaataccgtatacgccctacgggggaaaaatttattgctattggatgagcctatattagattagctagttggtggagtaatagcctaccaaggcaatgatctatagctgatctgagaggatgatcagccacactggaactgagatacggtccagactcctacgggaggcagcagtggggaatattggacaatgggcgaaagcctgatccagccatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggctggttaataagttaaaagtgaaatcccgaggcttaaccttggaattgcttttaaaactattaatctagagattgaaagaggatagaggaattcctgatgtagaggtaaaattcgtaaatattaggaggaacaccagtggcgaaggcgtctatctggttcaaatctgacgctgaagcgcgaaggcgtggggagcaaacaggattagataccctggtagtccacgctgtaaacgatgaatgttaaatatgggaagtttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccacttcttgacatggaaatcatacctattcgaagggatagggtcggttcggccggattttacacaagtgttgcatggctgtcgtcagctcgtgtcgtgagatgttgggttaagtcccgcaacgagcgcaaccctcatccttagttgctatcaggtaatgctgagtactttaaggaaactgccagtgataagctggaggaaggtggggatgatgtcaagtcatcatggcctttatggagtgggctacacacgtgctacaatggtgtctacaatgggctgcaaggtgcgcaagcctaagctaatccctaaaagacatctcagttcggattgtactctgcaactcgagtacatgaagttggaatcgctagtaatcgtggatcagcatgccacggtgaatacgttctcgggtcttgtacacactgcccgtcacgccatgggaattggtttcactcgaagctaatggcctaaccgcaaggaaggagttatttaaagtgggatcagtgactggggtgaagtcgtaacaaggtagcagtaggggaatctgcagctggattacctcctta

SEQ ID NO: 10064 - DNA, 1504 bp, Wolbachia endosymbiont of Trichogramma pretiosum
  ref <308>: DATABASE ACCESSION NUMBER: NCBI ACCESSION: NZ_CM003641.1
  ref <309>: DATABASE ENTRY DATE: 2019-04-01
  ref <313>: RELEVANT RESIDUES IN SEQ ID NO: (1)..(1504)
aaatttgagagtttgatcctggctcagaatgaacgctggcggcaggcctaacacatgcaagtcgaacggagttatattgtagcttgctatgatatagctcagtggcagacgggtgagtaatgtataggaatctacctagtagtacggaataattgttggaaacggcaactaataccgtatacgccctatgggggaaaaatttattgctattagatgagcctatattagattagctagttggtggagtaatagcctaccaaggcaatgatctatagctgatctgagaggatgatcagccacactggaactgagatacggtccagactcctacgggaggcagcagtggggaatattggacaatgggcgaaagcctgatccagccatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggctggttaataagttaaaagtgaaatcccgaggcttaaccttggaattgcttttaaaactattagcctagagattgaaagaggatagaggaattcctgatgtagaggtaaaattcgtaaatattaggaggaacaccagtggcgaaggcgtctatctggttcaaatctgacgctgaagcgcgaaggcgtggggagcaaacaggattagataccctggtagtccacgctgtaaacgatgaatgttaaatatgggaagtttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccacttcttgacatggaaatcatacctattcgaagggatagggtcggttcggccggatttcacacaagtgttgcatggctgtcgtcagctcgtgtcgtgagatgttgggttaagtcccgcaacgagcgcaaccctcatccttagttgccatcaggtaatgctgagtactttaaggaaactgccagtgataagctggaggaaggtggggatgatgtcaagtcatcatggcctttatggagtgggctacacacgtgctacaatggtgtctacaatgggttgcaaggtgcgcaagcctaagctaatccctaaaagacatctcagttcggattgtactctgcaactcgagtacatgaagttggaatcgctagtaatcgtggatcagcatgccacggtgaatacgttctcgggtcttgtacacactgcccgtcacgccatgggaattggtttcactcgaagctaatggcctaaccgcaaggaaggagttatttaaagtgggatcagtgactggggtgaagtcgtaacaaggtagcagtaggggaatctgcagctggattacctcctta

SEQ ID NO: 10065 - DNA, 1505 bp, Wolbachia pipientis
  ref <308>: DATABASE ACCESSION NUMBER: NCBI ACCESSION: NZ_CP031221.1
  ref <309>: DATABASE ENTRY DATE: 2019-04-01
  ref <313>: RELEVANT RESIDUES IN SEQ ID NO: (1)..(1505)
aaatttgagagtttgatcctggctcagaatgaacgctggcggcaggcctaacacatgcaagtcggacggagttatattgtagcttgctatggtataacttagtggcagacgggtgagtaatgtataggaatctacctagtagtacggaataattgttggaaacggcaactaataccgtatacgccctacgggggaaaaatttattgctattagatgagcctatattagattagctagttggtggagtaatagcctaccaaggcaatgatctatagctgatctgagaggatgatcagccacactggaactgagatacggtccagactcctacgggaggcagcagtggggaatattggacaatgggcgaaagcctgatccagccatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggctggttaataagttaaaagtgaaatcccgaggcttaaccttggaattgcttttaaaactattaatctagagattgaaagaggatagaggaattcctgatgtagaggtaaaattcgtaaatattaggaggaacaccagtggcgaaggcgtctatctggttcaaatctgacgctgaagcgcgaaggcgtggggagcaaacaggattagataccctggtagtccacgctgtaaacgatgaatgttaaatatgggaagtttactttctgtattacagctaacgcgttaaacattccgcctggggactacggtcgcaagattaaaactcaaaggaattgacggggacccgcacaagcggtggagcatgtggtttaattcgatgcaacgcgaaaaaccttaccacttcttgacatggaaatcatacctattcgaagggatagggtcggttcggccggatttcacacaagtgttgcatggctgtcgtcagctcgtgtcgtgagatgttgggttaagtcccgcaacgagcgcaaccctcatccttagttgctatcaggtaatgctgagtactttaaggaaactgccagtgataagctggaggaaggtggggatgatgtcaagtcatcatggcctttatggagtgggctacacacgtgctacaatggtgtctacaatgggttgcaaggtgcgcaagcctaagctaatccctaaaagacatctcagttcggattgtactctgcaactcgagtacatgaagttggaatcgctagtaatcgtggatcagcatgccacggtgaatacgttctcgggtcttgtacacactgcccgtcacgccatgggaattggtttcactcgaagctaatggcctaaccgcaaggaaggagttatttaaagtgggatcagtgactggggtgaagtcgtaacaaggtagcagtaggggaatctgcagctggattacctccttag

SEQ ID NO: 10066 - DNA, 480 bp, Wolbachia sp. wMel AMD
  ref <308>: DATABASE ACCESSION NUMBER: NCBI ACCESSION: NZ_MNCG01000169.1
  ref <309>: DATABASE ENTRY DATE: 2019-04-01
  ref <313>: RELEVANT RESIDUES IN SEQ ID NO: (1)..(480)
cagctcgtgtcgtgagatgttgggttaagtcccgcaacgagcgcaaccctcatccttagttaccatcaggtaatgctggggactttaaggaaactgccagtgataaactggaggaaggtggggatgatgtcaagtcatcatggcccttatggagtgggctacacacgtgctacaatggtggctacaatgggctgcaaagtcgcgaggctaagctaatcccttaaaagccatctcagttcggattgtactctgcaactcgagtgcatgaagttggaatcgctagtaatcgtggatcagcacgccacggtgaatacgttctcgggtcttgtacacactgcccgtcacgccatgggaattggtttcactcgaagctaacgacctaaccgcaaggagggagttatttaaagtgggatcggtgactggggtgaagtcgtaacaaggtagcagtaggggaatctgcagctggattacctccttagg

SEQ ID NO: 10067 - DNA, 480 bp, Wolbachia sp. wMel KL; identical to SEQ ID NO: 10066
  ref <308>: DATABASE ACCESSION NUMBER: NCBI ACCESSION: NZ_MLZJ01000170.1
  ref <309>: DATABASE ENTRY DATE: 2019-04-01
  ref <313>: RELEVANT RESIDUES IN SEQ ID NO: (1)..(480)

SEQ ID NO: 10068 - DNA, 779 bp, Wolbachia sp. wRi
  ref <308>: DATABASE ACCESSION NUMBER: NCBI ACCESSION: NZ_MKIF01000097.1
  ref <309>: DATABASE ENTRY DATE: 2019-04-01
  ref <313>: RELEVANT RESIDUES IN SEQ ID NO: (1)..(779)
aaatttgagagtttgatcctggctcagaatgaacgctggcggcaggcctaacacatgcaagtcgaacggagttatattgtagcttgctatggtataacttagtggcagacgggtgagtaatgtataggaatctacctagtagtacggaataattgttggaaacggcaactaataccgtatacgccctacgggggaaaaatttattgctattagatgagcctatattagattagctagttggtggagtaatagcctaccaaggcaatgatctatagctgatctgagaggatgatcagccacactggaactgagatacggtccagactcctacgggaggcagcagtggggaatattggacaatgggcgaaagcctgatccagccatgccgcatgagtgaagaaggcctttgggttgtaaagctcttttagtgaggaagataatgacggtactcacagaagaagtcctggctaactccgtgccagcagccgcggtaatacggagagggctagcgttattcggaattattgggcgtaaagggcgcgtaggcggattagtaagttaaaagtgaaatcccaaggctcaaccttggaattgcttttaaaactgctaatctagagattgaaagaggatagaggaattcctagtgtagaggtgaaattcgtaaatattaggaggaacaccagtggcgaaggcgtctatctggttcaaatctgacgctgaggcgcgaaggcgtggggagcaaacaggattagataccctggtagtccacgctgtaaacg

SEQ ID NO: 10069 - DNA, 1503 bp, Wolinella succinogenes
  ref <308>: DATABASE ACCESSION NUMBER: NCBI ACCESSION: NZ_LR134366.1
  ref <309>: DATABASE ENTRY DATE: 2019-04-01
  ref <313>: RELEVANT RESIDUES IN SEQ ID NO: (1)..(1503)
attatggagagtttgatcctggctcagagtgaacgctggcggcgtgcctaatacatgcaagtcgaacggtaacagggtgtagcttgctatactgctgacgagtggcgcacgggtgagtaatgcataggttatgtgccccatagtctggaatagccactggaaacggtgattaataccggatattcccgagaggggaaagtttttcgctatgggatcagcctatgtcctatcagcttgttggtgaggtaatggctcaccaaggctatgacgggtatccggcctgagagggtgatcggacacactggaactgagacacggtccagactcctacgggaggcagcagtagggaatattgctcaatgggcgaaagcctgaagcagcaacgccgcgtggaggatgaaggtcttcggattgtaaactccttttctaagagaagattatgacggtatcttaggaataagcaccggctaactccgtgccagcagccgcggtaatacggagggtgcaagcgttactcggaatcactgggcgtaaagagcacgtaggcggccttgcaagtcagatgtgaaatccaacggcttaaccgttgaactgcatttgaaactgcaaggctagagtatgggagaggtaggtggaattctcggtgtaggggtaaaatccgtagagatcgagaggaatactcattgcgaaggcgacctgctggaacattactgacgctgaggtgcgaaagcgtggggagcaaacaggattagataccctggtagtccacgccctaaacgatgaatgctagttgttgccctgcttgtcagggcagtaatgcagttaacacattaagcattccgcctggggagtacggtcgcaagattaaaactcaaaggaatagacggggacccgcacaagcggtggagcatgtggtttaattcgaagatacgcgaagaaccttacctgggcttgacattgatagaatcctatagagatatgggagtgccagtttactggagcttgaaaacaggtgctgcacggctgtcgtcagctcgtgtcgtgagatgttgggttaagtcccgcaacgagcgcaaccctcgtcactagttgctaacggttcggccgagcactctagtgagactgccttcgcaaggaggaggaaggtgaggacgacgtcaagtcatcatggcccttacgcccagggctacacacgtgctacaatggtgtgtacaaagagaagcaataccgcgaggtggagcaaatctttaaaacacatctcagttcggattgtagtctgcaactcgactacatgaagctggaatcgctagtaatcgtagatcagcaatgctacggtgaatacgttcccgggtcttgtactcaccgcccgtcacaccatgggagttgtattcgccttaagccgggacgctaaactggctaccgtccacggcggatgcagcgactggggtgaagtcgtaacaaggtaaccgtaggtgaacctgcggttggatcacctcctttcta

SEQ ID NO: 10070 - DNA, 1470 bp, Woodsholea maritima
  ref <308>: DATABASE ACCESSION NUMBER: NCBI ACCESSION: NZ_KB908060.1
  ref <309>: DATABASE ENTRY DATE: 2019-04-01
  ref <313>: RELEVANT RESIDUES IN SEQ ID NO: (1)..(1470)
caatttgagagtttgattctggctcagaacgaacgctggcggaaggcttaacacatgcaagtcgagcgcaccttcgggtgagcggcagacgggtgagtaacgcgtgggaacatgcctatcggtacggaatagcctcgggaaactgggagtaataccgtatacgtcctaagggagaaagatttatcgccgatagattggcccgcgttagattagcttgttggtgaggtaatggctcaccaaggcgacgatctatagctggtttgagaggatgatcagccacactgggactgagacacggcccagactcctacgggaggcagcagtggggaatcttagacaatgggcgcaagcctgatctagccattccgcgtgaatgatgaaggccttagggttgtaaaattctttcagctgggaagataatgactgtaccagcagaagaagccccggctaactccgtgccagcagccgcggtaatacggagggggctagcgttgttcggaattactgggcgtaaagcgcacgtaggcggattatcaagttgggggtgaaatcccggggctcaacctcggaactgccttcaaaactgatagtctagaatccaggagaggtgtgtggaattccgagtgtagaggtgaaattcgtagatattcggaggaacaccagaggcgaaggcgacacactggactggtattgacgctgaggtgcgaaagcgtggggagcaaacaggattagataccctggtagtccacgccgtaaacgatgagagctagttgtcaggcagcatgctgtttggtgacgcagctaacgcattaagctctccgcctggggagtacggccgcaaggttaaaactcaaagaaattgacgggggcccgcacaagcggtggagcatgtggtttaattcgaagcaacgcgcagaaccttacctgctcttgacatcctcatcgcggttaccagagatggtttccttcagttcggctggatgagtgacaggtgctgcatggctgtcgtcagctcgtgtcgtgagatgttgggttaagtcccgcaacgagcgcaaccctcgccgttagttgccagcaggtttggctgggcactctaacgggactgccggtgttaaaccggaggaaggtggggatgacgtcaagtcctcatggcccttacgagcagggctacacacgtgctacaatggcagtgacagagagctaatctctaaaagctgtctcagttcggattgtcttctgcaactcgaaggcatgaagtcggaatcgctagtaatcgcggatcagcatgccgcggtgaatacgttcccgggccttgtacacaccgcccgtcacaccatgggagttggtattacccgacgacgctgcgctaaccttttaggaggcaggcggccacggtaggatcagcgactggggtgaagtcgtaacaaggtagccgtaggggaacctgcggctggatcacctcctttctaa

SEQ ID NO: 10071 - DNA, 1490 bp, Xanthobacter autotrophicus
  ref <308>: DATABASE ACCESSION NUMBER: NCBI ACCESSION: NC_009720.1
  ref <309>: DATABASE ENTRY DATE: 2019-04-01
  ref <313>: RELEVANT RESIDUES IN SEQ ID NO: (1)..(1490)
aacttgagagtttgatcctggctcagagcgaacgctggcggcaggcctaacacatgcaagtcgagcgcccagcaatgggagcggcagacgggtgagtaacacgtggggatctacccaatggtacggaataacccagggaaacttggactaataccgtatgtgcccttcgggggaaagatttatcgccattggatgaacccgcgtcggattagctagttggtgaggtaaaggctcaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccggtgaagataatgacggtaaccggagaagaagccccggctaacttcgtgccagcagccgcggtaatacgaagggggctagcgttgctcggaatcactgggcgtaaagcgcacgtaggcgggttgttaagtcagaggtgaaatcctggagctcaactccagaactgcctttgatactggcgaccttgagttcgagagaggttggtggaactgcgagtgtagaggtgaaattcgtagatattcgcaagaacaccagtggcgaaggcggccaactggctcgatactgacgctgaggtgcgaaagcgtggggagcaaacaggattagataccctggtagtccacgccgtaaacgatggatgctagccgttaggcagcttgctgcttagtggcgcagctaacgcattaagcatcccgcctggggagtacggtcgcaagattaaaactcaaaggaattgacgggggcccgcacaagcggtggagcatgtggtttaattcgaagcaacgcgcagaaccttaccagcctttgacatggcaggacgatttccagagatggatctcttccagcaatggacctgcacacaggtgctgcatggctgtcgtcagctcgtgtcgtgagatgttgggttaagtcccgcaacgagcgcaaccctcgcctctagttgccagcattcagttgggcactctagagggactgccggtgataagccgcgaggaaggtggggatgacgtcaagtcctcatggcccttacgggctgggctacacacgtgctacaatggcggtgacagtgggatgcgaaagggcgacctctagcaaatctccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggctttacccgaaggcgctgcgctaacccgcaagggaggcaggcgaccacggtagggtcagcgactggggtgaagtcgtaacaaggtagccgtaggggaacctgcggctggatcacctcctttctaagg

SEQ ID NO: 10072 - DNA, 1491 bp, Xanthobacter sp. 126
  ref <308>: DATABASE ACCESSION NUMBER: NCBI ACCESSION: NZ_JAFO01000001.1
  ref <309>: DATABASE ENTRY DATE: 2019-04-01
  ref <313>: RELEVANT RESIDUES IN SEQ ID NO: (1)..(1491)
caacttgagagtttgatcctggctcagagcgaacgctggcggcaggcctaacacatgcaagtcgagcgcccagcaatgggagcggcagacgggtgagtaacacgtggggatctacccaatggtacggaataacccagggaaacttggattaataccgtatgtgcccttcgggggaaagatttatcgccattggatgaacccgcgtcggattagctagttggtgaggtaaaggctcaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccggtgaagataatgacggtaaccggagaagaagccccggctaacttcgtgccagcagccgcggtaatacgaagggggctagcgttgctcggaatcactgggcgtaaagcgcacgtaggcggatcgttaagtcaggggtgaaatcctggagctcaactccagaactgcccttgatactggcgatctcgagttcgagagaggttggtggaactccgagtgtagaggtgaaattcgtagatattcggaagaacaccagtggcgaaggcggccaactggctcgatactgacgctgaggtgcgaaagcgtggggagcaaacaggattagataccctggtagtccacgccgtaaacgatggatgctagccgttggggggtttacctctcagtggcgcagctaacgccttaagcatcccgcctggggagtacggtcgcaagattaaaactcaaaggaattgacgggggcccgcacaagcggtggagcatgtggtttaattcgaagcaacgcgcagaaccttaccagcctttgacatggcaggacgacttccggagacggatttcttccagcaatggacctgcacacaggtgctgcatggctgtcgtcagctcgtgtcgtgagatgttgggttaagtcccgcaacgagcgcaaccctcgcctctagttgccatcattcagttgggcactctagagggactgccggtgataagccgagaggaaggtggggatgacgtcaagtcctcatggcccttacgggctgggctacacacgtgctacaatggcggtgacagtgggatgcgaacccgcgagggtaagcaaatctccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggctttacccgaaggcgctgcgctaacccgcaagggaggcaggcgaccacggtagggtcagcgactggggtgaagtcgtaacaaggtagccgtaggggaacctgcggctggatcacctcctttctaagg

SEQ ID NO: 10073 - DNA, 1491 bp, Xanthobacter sp. 91; identical to SEQ ID NO: 10072
  ref <308>: DATABASE ACCESSION NUMBER: NCBI ACCESSION: NZ_JNIB01000001.1
  ref <309>: DATABASE ENTRY DATE: 2019-04-01
  ref <313>: RELEVANT RESIDUES IN SEQ ID NO: (1)..(1491)

SEQ ID NO: 10074 - DNA, 1490 bp, Xanthobacter tagetidis
  ref <308>: DATABASE ACCESSION NUMBER: NCBI ACCESSION: NZ_RCTF01000015.1
  ref <309>: DATABASE ENTRY DATE: 2019-04-01
  ref <313>: RELEVANT RESIDUES IN SEQ ID NO: (1)..(1490)
tcaacttgagagtttgatcctggctcagagcgaacgctggcggcaggcctaacacatgcaagtcgagcgcccagcaatgggagcggcagacgggtgagtaacgcgtggggatctgccctttggtacggaataacccagggaaacttggactaataccgtatgtgcccttcgggggaaagatttatcgccaaaggatgaacccgcgtctgattagctagttggtggggtaatggcccaccaaggcgacgatcagtagctggtctgagaggatgatcagccacactgggactgagacacggcccagactcctacgggaggcagcagtggggaatattggacaatgggcgaaagcctgatccagccatgccgcgtgagtgatgaaggccttagggttgtaaagctctttcgccggtgaagataatgacggtaaccggagaagaagccccggctaacttcgtgccagcagccgcggtaatacgaagggggctagcgttgctcggaatcactgggcgtaaagcgcacgtaggcggatcgttaagtcaggggtgaaatcctggagctcaactccagaactgcccttgatactggcgatctcgagttcgagagaggttggtggaactccgagtgtagaggtgaaattcgtagatattcggaagaacaccagtggcgaaggcggccaactggctcgatactgacgctgaggtgcgaaagcgtggggagcaaacaggattagataccctggtagtccacgccgtaaacgatggatgctagccgttggggggtttacctttcagtggcgcagctaacgccttaagcatcccgcctggggagtacggtcgcaagattaaaactcaaaggaattgacgggggcccgcacaagcggtggagcatgtggtttaattcgaagcaacgcgcagaaccttaccagcctttgacatggcaggacgacttccggagacggatttcttccagcaatggacctgcacacaggtgctgcatggctgtcgtcagctcgtgtcgtgagatgttgggttaagtcccgcaacgagcgcaaccctcgcctctagttgccagcattaagttgggcactctagagggactgccggtgataagccgagaggaaggtggggatgacgtcaagtcctcatggcccttacgggctgggctacacacgtgctacaatggtggtgacagtgggatgcaaaagggcgacctctagcaaatctccaaaagccatctcagttcggattgcactctgcaactcgagtgcatgaagttggaatcgctagtaatcgtggatcagcatgccacggtgaatacgttcccgggccttgtacacaccgcccgtcacaccatgggagttggctttacccgaaggcgctgcgctaacccgcaagggaggcaggcgaccacggtagggtcagcgactggggtgaagtcgtaacaaggtagccgtaggggaacctgcggctggatcacctcctttctaa

SEQ ID NO: 10075 - DNA, 1497 bp, Xanthobacteraceae bacterium 501b
  ref <308>: DATABASE ACCESSION NUMBER: NCBI ACCESSION: NZ_KB899087.1
  ref <309>: DATABASE ENTRY DATE: 2019-04-01
  ref <313>: RELEVANT RESIDUES IN SEQ ID NO: (1)..(1497)
tcattcaacttgagagtttgatcctggctcagaacgaacgctggcggcaggcttaacacatgcaagtcgaacgccccgcaaggggagtggcagacgggtgagtaacacgtggggatctgcccaatggtacggaataatttcgggaaactgggactaataccgtatgagcccgcaaggggaaagatttatcgccattggatgaacccgcgtcggattagctagttggtgtggtaaaggcgcaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccgacgaagataatgacggtagtcggagaagaagccccggctaacttcgtgccagcagccgcggtaatacgaagggggctagcgttgttcggaatcactgggcgtaaagcgcacgtaggcggatatttaagtcaggggtgaaagcctggagctcaactccagaactgcccttgatactgggtatctcgagtccggaagaggtaagtggaactgcgagtgtagaggtgaaattcgtagatattcgcaagaacaccagtggcgaaggcggcttactggtccggtactgacgctgaggtgcgaaagcgtggggagcaaacaggattagataccctggtagtccacgccgtaaacgatggaggctagccgttggtgagcatgctcatcagtggcgcagctaacgcattaagcctcccgcctggggagtacggtcgcaagattaaaactcaaaggaattgacgggggcccgcacaagcggtggagcatgtggtttaattcgaagcaacgcgcagaaccttaccagcctttgacatgtcccggacggttaccagagatggtttcttctcttcggagccgggaacacaggtgctgcatggctgtcgtcagctcgtgtcgtgagatgttgggttaagtcccgcaacgagcgcaaccctcgcccttagttgccatcattaagttgggcactctagggggactgccggtgataagccgagaggaaggtggggatgacgtcaagtcctcatggcccttacgggctgggctacacacgtgctacaatggcggtgacagtgggaagcgaacccgcgagggtaagcaaatctccaaaagccgtctcagttcggattgcactctgcaactcgagtgcatgaagttggaatcgctagtaatcgtggatcagcatgccacggtgaatacgttcccgggccttgtacacaccgcccgtcacaccatgggagttggttttacccgaaggcgctgcgctaacccgcaagggaggcaggcgaccacggtagggtcagcgactggggtgaagtcgtaacaaggtagccgtaggggaacctgcggctggatcacctcctttctaagga

SEQ ID NO: 10076 - DNA, 1539 bp, Xanthomonadaceae bacterium AQ6-296
  ref <308>: DATABASE ACCESSION NUMBER: NCBI ACCESSION: NZ_CP035704.1
  ref <309>: DATABASE ENTRY DATE: 2019-04-01
  ref <313>: RELEVANT RESIDUES IN SEQ ID NO: (1)..(1539)
aactgaagagtttgatcctggctcagagtgaacgctggcggcatgcctaacacatgcaagtcgaacggtaacaggcccgcaagggtgctgacgagtggcggacgggtgaggaatacataggaatctgccctatcgtgggggataacgtagggaaacttacgctaataccgcatacgaccgagaggtgaaagcgggggaccgcaaggcctcgcgcgatgggatgagcctatgtcggattagctagttggcggggtaagagcccaccaaggcgacgatccgtagctggtctgagaggatgatcagccacactgggactgagacacggcccagactcctacgggaggcagcagtggggaatattggacaatgggggcaaccctgatccagcaatgccgcgtgtgtgaagaaggccttcgggttgtaaagcacttttaccaggaacgaaacgcgccggattaatactttggcgaactgacggtacctggggaataagcaccggctaacttcgtgccagcagccgcggtaatacgaagggtgcaagcgttactcggaattactgggcgtaaagcgtgcgtaggtggcttgttaagtcgaatgtgaaagccccgggctcaacctgggaatggcatccgatactggcaagctagagttcgatagagggtagtggaattccaggtgtagcggtgaaatgcgtagagatctggaggaacatcagtggcgaaggcggctacctggatcagaactgacactgaggcacgaaagcgtggggagcaaacaggattagataccctggtagtccacgccctaaacgatgccgactggacgttgggaggaactcgcctctcagtgtcgaagctaacgcgttaagtcggccgcctggggagtacggtcgcaagactgaaactcaaaggaattgacgggggcccgcacaagcggtggagtatgtggtttaattcgatgcaacgcgaagaaccttacctggccttgacatccacggaacttaccagagatggtttggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagactgccggtgacaaaccggaggaaggtggggatgacgtcaagtcatcatggcccttacggccagggctacacacgtactacaatggtcggtacagagggttgcaataccgcgaggtggagccaatcccagaaagccgatctcagtccggatcggagtctgcaactcgactccgtgaagtcggaatcgctagtaatcgcgaatcagcattgtcgcggtgaatacgttcccgggccttgtacacaccgcccgtcacaccatgggagtctgttgcaccagaagcaggtagcttaaccttcgggagggcgcttgccacggtgtggccgatgactggggtgaagtcgtaacaaggtagccgtatcggaaggtgcggctggatcacctcctttc

SEQ ID NO: 10077 - DNA, 1548 bp, Xanthomonadaceae bacterium NML93-0399
  ref <308>: DATABASE ACCESSION NUMBER: NCBI ACCESSION: NZ_NTJI01000007.1
  ref <309>: DATABASE ENTRY DATE: 2019-04-01
  ref <313>: RELEVANT RESIDUES IN SEQ ID NO: (1)..(1548)
taagtgaagagtttgatcctggctcagagtgaacgctggcggcaggcctaacacatgcaagtcgaacggcagcacagaggagcttgctccttgggtggcgagtggcggacgggtgaggaatacatcggaatctgcctatttgtgggggataacgtagggaaacttacgctaataccgcatacgacctacgggtgaaagcggaggaccttcgggcttcgcgcagatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggtttgttaagtctgatgtgaaagccctgggctcaacctgggaattgcattggatactggcaggctagagtgcggtagagggtagtggaattcccggtgtagcagtgaaatgcgtagagatcgggaggaacatccgtggcgaaggcgactacctggaccagcactgacactgaggcacgaaagcgtggggagcaaacaggattagataccctggtagtccacgccctaaacgatgcgaactggatgttgggttcaactaggaactcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggccttgacatgcacggaactttccagagatggattggtgccttcgggaaccgtgacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatgggaaggacagagggctgcgaacccgcgagggcaagccaatcccagaaaccttctctcagtccggatcggagtctgcaactcgactccgtgaagtcggaatcgctagtaatcgcagatcagcattgctgcggtgaatacgttcccgggccttgtacacaccgcccgtcacaccatgggagtttgttgcaccagaagcaggtagcctaaccttcgggagggcgcttgccacggtgtggccgatgactggggtgaagtcgtaacaaggtagccgtatcggaaggtgcggctggatcacctcctttaga

SEQ ID NO: 10078 - DNA, 1487 bp, Xenococcus sp. PCC 7305
  ref <308>: DATABASE ACCESSION NUMBER: NCBI ACCESSION: NZ_ALVZ01000003.1
  ref <309>: DATABASE ENTRY DATE: 2019-04-01
  ref <313>: RELEVANT RESIDUES IN SEQ ID NO: (1)..(1487)
catggagagtttgatcctggctcaggatgaacgctggcggtatgcctaacacatgcaagtcgaacgaaatcttcggatttagtggcggacgggtgagtaacgcgtgagaatctgccttcaggacggggacaacagttggaaacgactgctaatacccgatgtgccgcaaggtgaaatttatttagcctgaagaggagctcgcgtccgattagctagttggggtggtaaaagcgcaccaaggcaacgatcggtagctggtctgagaggatgagcagccacactgggactgagacacggcccagactcctacgggaggcagcagtggggaattttccgcaatgggcgaaagcctgacggagcaataccgcgtgagggaggaaggcttttgggttgtaaacctcttttctcaaggaagaagaactgacggtacttgaggaatcagcatcggctaactccgtgccagcagccgcggtaatacggaggatgcaagcgttatccggaattattgggcgtaaagcgtccgcaggtggtacatcaagtccgctgttaaagaccagggcttaaccccgggaaggcagtggaaactgatgaactagagtacggtaggggtagagggaattcccagtgtagcggtgaaatgcgtagagattgggaagaacaccagtggcgaaggcgctctactggacctgtactgacactcagggacgaaagctagggtagcgaaagggattagatacccctgtagtcctagccgtaaacgatggatactaggcgttgcttgtatcgacccgagcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccaggacttgacatcccgcgaatcttgatgaaagttgagagtgccttagggaacgcggagacaggtggtgcatggctgtcgtcagctcgtgtcgtgagatgttgggttaagtcccgcaacgagcgcaaccctcgtccttagttgccatcattaagttgggcactttaaggagactgccggtgacaaaccggaggaaggtggggatgacgtcaagtcagcatgccccttacgtcctgggctacacacgtactacaatggttgggacaaagggcagcgagcgagcaatcgtaagcgaatctcatcaaacccagcctcagttcagattgcaggctgcaactcgcctgcatgaaggaggaatcgctagtaatcgcaggtcagcatactgcggtgaatccgttcccgggccttgtacacaccgcccgtcacaccatggaagctggtcacgcccgaagtcgttaccctaaccgaaaggagggggatgccgaaggcaggactggtgactggggtgaagtcgtaacaaggtagccgtaccggaaggtgtggctggatcacctcctttaa

SEQ ID NO: 10079 - DNA, 1541 bp, Xenophilus sp. E41
  ref <308>: DATABASE ACCESSION NUMBER: NCBI ACCESSION: NZ_QPIB01000008.1
  ref <309>: DATABASE ENTRY DATE: 2019-04-01
  ref <313>: RELEVANT RESIDUES IN SEQ ID NO: (1)..(1541)
agatcgaactgtagagtttgatcctggctcagattgaacgctggcggcatgccttacacatgcaagtcgaacggtaacaggtcttcggatgctgacgagtggcgaacgggtgagtaatacatcggaacgtgcccagtcgtgggggataactacgcgaaagcgtagctaataccgcatacgatctatggatgaaagcgggggatcgcaagacctcgcgcgattggagcggccgatggcagattaggtagttggtggggtaaaggctcaccaagccgacgatctgtagctggtctgagaggacgaccagccacactgggactgagacacggcccagactcctacgggaggcagcagtggggaattttggacaatgggcgcaagcctgatccagccatgccgcgtgcaggatgaaggccttcgggttgtaaactgcttttgtacggaacgaaaagtctctttctaataaagagggatcatgacggtaccgtaagaataagcaccggctaactacgtgccagcagccgcggtaatacgtagggtgcaagcgttaatcggaattactgggcgtaaagcgtgcgcaggcggtgatgtaagacagttgtgaaatccccgggctcaacctgggaactgcatctgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacaggattagataccctggtagtccacgccctaaacgatgtcaactggttgttgggaattcactttctcagtaacgaagctaacgcgtgaagttgaccgcctggggagtacggccgcaaggttgaaactcaaaggaattgacggggacccgcacaagcggtggatgatgtggtttaattcgatgcaacgcgaaaaaccttacccacctttgacatgtacggaatttgccagagatggcttagtgctcgaaagagaaccgtaacacaggtgctgcatggctgtcgtcagctcgtgtcgtgagatgttgggttaagtcccgcaacgagcgcaacccttgtcattagttgctacattcagttgggcactctaatgagactgccggtgacaaaccggaggaaggtggggatgacgtcaagtcctcatggcccttataggtggggctacacacgtcatacaatggctggtacaaagggttgccaacccgcgagggggagctaatcccataaagccagtcgtagtccggatcgcagtctgcaactcgactgcgtgaagtcggaatcgctagtaatcgtggatcagaatgtcacggtgaatacgttcccgggtcttgtacacaccgcccgtcacaccatgggagcgggttctgccagaagtagttagcctaaccgcaaggagggcgattaccacggcagggttcgtgactggggtgaagtcgtaacaaggtagccgtatcggaaggtgcggctggatcacctcctttctg

SEQ ID NO: 10080 - DNA, 1546 bp, Xenorhabdus budapestensis
  ref <308>: DATABASE ACCESSION NUMBER: NCBI ACCESSION: NZ_NIBS01000085.1
  ref <309>: DATABASE ENTRY DATE: 2019-04-01
  ref <313>: RELEVANT RESIDUES IN SEQ ID NO: (1)..(1546)
tttaattgaagagtttgatcatggctcagattgaacgctggcggcaggcctaacacatgcaagtcgggcggcagcgggaggaagcgtgcttccttgccggcgagcggcggacgggtgagtaatgtctggggatctgcccgatggagggggataaccactggaaacggtggctaataccgcataacctcctgggagcaaagtgggggaccttcgggcctcacgccatcggatgaacccagatgggattagctagtaggtggggtaagggctcacctaggcgacgatccctagctggtctgagaggatgaccagccacactgggactgagacacggcccagactcctacgggaggcagcagtggggaatattgcacaatgggcggcagcctgatgcagccatgccgcgtgtatgaagaaggccttcgggttgtaaagtactttcagcggggaggaaggcataaaacttaataggttttatgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggcttaacccgggaacggcatctaagactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgccgtaaacgatgtcgatttggaggttgtggccttgagctgtggcttccggagctaacgcgttaaatcgaccgcctggggagtacggtcgcaagattaaaactcaaatgaattgacgggggcccgcacaagcggtggagcatgtggtttaattcgatgcaacgcgaagaaccttacctactcttgacatccagcgaagcctttggagacagaggcgtgccttcgggaacgctgagacaggtgctgcatggctgtcgtcagctcgtgttgtgaaatgttgggttaagtcccgcaacgagcgcaacccttatcctttgttgccagcacgtcatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgcagatcagcatgctgcggtgaatacgttcccgggccttgtacacaccgcccgtcacaccatgggagtgggtggcaaaagaagtcggtagcttaacctgctggagggcgctgaccactttgtgatccatgactggggtgaagtcgtaacaaggtaaccgtaggggaacctgcggttggatcacctccttaa

SEQ ID NO: 10081 - DNA, 1546 bp, Xenorhabdus cabanillasii
  ref <308>: DATABASE ACCESSION NUMBER: NCBI ACCESSION: NZ_QTUB01000001.1
  ref <309>: DATABASE ENTRY DATE: 2019-04-01
  ref <313>: RELEVANT RESIDUES IN SEQ ID NO: (1)..(1546)
ttaattgaagagtttgatcatggctcagattgaacgctggcggcaggcctaacacatgcaagtcgggcggtaacaggaaagggcttttgcacttttgctgacgagcggcggacgggtgagtaatgtctggggatctgcccggtagagggggataaccactggaaacggtggctaataccgcataacctctttggagcaaagtgggggaccttcgggcctcacgctatcggatgaacccagatgggattagctagtaggtggggtaagggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcgtgagtctgaacagggctcacgattgacgttacccgcagaagaagcaccggctaactccgtgccagcagccgcggtaatacggagggtgcaagcgttaatcggaattactgggcgtaaagcgcacgcaggcggccaattaagttagatgtgaaatccccgggcttaacccgggaacggcatctaagactggttggctggagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgccgtaaacgatgtcgatttggaggttgtgcccttgaggtgtggcttccggagctaacgcgttaaatcgaccgcctggggagtacggtcgcaagattaaaactcaaatgaattgacgggggcccgcacaagcggtggagcatgtggtttaattcgatgcaacgcgaagaaccttacctactcttgacatccacggaatttggcagagatgctgaagtgccttcgggaaccgtgagacaggtgctgcatggctgtcgtcagctcgtgttgtgaaatgttgggttaagtcccgcaacgagcgcaacccttatcctttgttgccagcacgtgatggtgggaactcaagggagactgccggtgataaaccggaggaaggtggggatgacgtcaagtcatcatggccctgacgagtagggctacacacgtgctacaatggcggatacaaagagaagcgacctcgcgagagcaagcggaactcataaagtctgtcgtagtccggattggagtctgcaactcgactccatgaagtcggaatcgctagtaatcgtagatcagcatgctacggtgaatacgttcccgggccttgtacacaccgcccgtcacaccatgggagtgggtggcaaaagaagtcggtagcttaacctgcgggagggcgctgaccactttgtgactcatgactggggtgaagtcgtaacaaggtaaccgtaggggaacctgcggttggatcacctcctta

SEQ ID NO: 10082 - DNA, 1544 bp, Xenorhabdus ehlersii
  ref <308>: DATABASE ACCESSION NUMBER: NCBI ACCESSION: NZ_RAQI01000001.1
  ref <309>: DATABASE ENTRY DATE: 2019-04-01
  ref <313>: RELEVANT RESIDUES IN SEQ ID NO: (1)..(1544)
ttaattgaagagtttgatcatggctcagattgaacgctggcggcaggcctaacacatgcaagtcgagcggcagcggggggaagcgtgctttcctgccggcgagcggcggacgggtgagtaatgtctggggatctgcctgatggagggggataaccactggaaacggtggctaataccgcataacctctgaggagcaaagtgggggaccttcgggcctcacgccatcggatgaacccagatgggattagctagtaggtggggtaaaggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcatagagccgaatacgctttatgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggcttaacctgggaatggcatctaagactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtggccttgagctgtggcttccggagctaacgcgttaaatcgaccgcctggggagtacggtcgcaagattaaaactcaaatgaattgacgggggcccgcacaagcggtggagcatgtggtttaattcgatgcaacgcgaagaaccttacctactcttgacatccagcgaagcctttagagatagaggcgtgccttcgggaacgctgagacaggtgctgcatggctgtcgtcagctcgtgttgtgaaatgttgggttaagtcccgcaacgagcgcaacccttatcctttgttgccagcacgttatggtgggaactcaagggagactgccggtgataaaccggaggaaggtggggatgacgtcaagtcatcatggcccttacgagtagggctacacacgtgctacaatggcggatacaaagagaagcgacctcgcgagagcaagcggacctcataaagtctgtcgtagtccggattggagtctgcaactcgactccatgaagtcggaatcgctagtaatcgcagatcagaatgctgcggtgaatacgttcccgggccttgtacacaccgcccgtcacaccatgggagtgggttgcaaaagaagtcggtagcttaacctgtaggagggcgctgaccactttgtgattcatgactggggtgaagtcgtaacaaggtaaccgtaggggaacctgcggttggatcacctcctta

SEQ ID NO: 10083 - DNA, 1546 bp, Xenorhabdus innexi
  ref <308>: DATABASE ACCESSION NUMBER: NCBI ACCESSION: NZ_LT699778.1
  ref <309>: DATABASE ENTRY DATE: 2019-04-01
  ref <313>: RELEVANT RESIDUES IN SEQ ID NO: (1)..(1546)
tttaattgaagagtttgatcatggctcagattgaacgctggcggcaggcctaacacatgcaagtcgagcggcagcggggggaagcttgcttccctgccggcgagcggcggacgggtgagtaatgtctggggatctgcccggtagagggggataaccactggaaacggtggctaataccgcataacctcttaggagcaaagtgggggaccttcgggcctcacgctatcggatgaacccagatgggattagctagtaggtggggtaatggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcgtagaaccgaatacgttttacgattgacgttacccgcagaagaagcaccggctaactccgtgccagcagccgcggtaatacggagggtgcaagcgttaatcggaattactgggcgtaaagcgcacgcaggcggccaattaagttagatgtgaaagccccgggcttaacctgggaacggcatctaagactggttggctagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgccgtaaacgatgtcaacttggaggttgtggccttgagccgtggcttccggagctaacgcgttaagttgaccgcctggggagtacggtcgcaagattaaaactcaaatgaattgacgggggcccgcacaagcggtggagcatgtggtttaattcgatgcaacgcgaagaaccttacctactcttgacatccagcgaaacctttagagatagaggtgtgccttcgggaacgctgagacaggtgctgcatggctgtcgtcagctcgtgttgtgaaatgttgggttaagtcccgcaacgagcgcaacccttatcctttgttgccagcacgttatggtgggaactcaggggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaa

SEQ ID NO: 10084 - DNA, 1552 bp, Xenorhabdus mauleonii
  ref <308>: DATABASE ACCESSION NUMBER: NCBI ACCESSION: NZ_FORG01000055.1
  ref <309>: DATABASE ENTRY DATE: 2019-04-01
  ref <313>: RELEVANT RESIDUES IN SEQ ID NO: (1)..(1552)
tttaattgaagagtttgatcatggctcagattgaacgctggcggcaggcctaacacatgcaagtcgagcggcagcgggaagaagcttgcttctttgccggcgagcggcggacgggtgagtaatgtctggggatctgcccgatggagggggataaccactggaaacggtggctaataccgcataacctctgaggagcaaagtgggggaccttcgggcctcacgccatcggatgaacccagatgggattagctagtaggcggggtaatggcccacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcgtaggtcttaatacggcttacgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggcttaacctgggaactgcatctaagactggttggctagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggttgtgcccttgaggcgtggcttccggagctaacgcgttaaatcgaccgcctggggagtacggtcgcaagattaaaactcaaatgaattgacgggggcccgcacaagcggtggagcatgtggtttaattcgatgcaacgcgaagaaccttacctactcttgacatccacggaatttggcagagatgccgaagtgccttcgggaaccgtgagacaggtgctgcatggctgtcgtcagctcgtgttgtgaaatgttgggttaagtcccgcaacgagcgcaacccttatcctttgttgccagcacttcgggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 10085 - DNA, 1546 bp, Xenorhabdus nematophila
  ref <308>: DATABASE ACCESSION NUMBER: NCBI ACCESSION: NZ_CP032329.1
  ref <309>: DATABASE ENTRY DATE: 2019-04-01
  ref <313>: RELEVANT RESIDUES IN SEQ ID NO: (1)..(1546)
ttaattgaagagtttgatcatggctcagattgaacgctggcggcaggcctaacacatgcaagtcggacggtaacaggaaacagcttgctgttttgctgacgagtggcggacgggtgagtaatgtctggggatctgcccgatggagggggataaccactggaaacggtggctaataccgcatgacctcttgggagtaaagtgggggaccttcgggcctcacgccatcggatgaacccagatgggattagctagtaggcggggtaatggcccacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcgtaagtctgaacagggcttacgattgacgttacccgcagaagaagcaccggctaactccgtgccagcagccgcggtaatacggagggtgcaagcgttaatcggaattactgggcgtaaagcgcacgcaggcggtcaattaagttggatgtgaaatccccgggcttaacccgggaacggcatccaagactggttggctagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgctgtaaacgatgtcgatttggaggctgtgcccttgaggcgtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccggagtgccttcgggaaccgtgagacaggtgctgcatggctgtcgtcagctcgtgttgtgaaatgttgggttaagtcccgcaacgagcgcaacccttatcctttgttgccagcacgtgatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggggggcgcttaccactttgtgattcatgactggggtgaagtcgtaacaaggtaaccgtaggggaacctgcggttggatcacctccttacc

SEQ ID NO: 10086 - DNA, 1546 bp, Xenorhabdus sp. KJ12.1
  ref <308>: DATABASE ACCESSION NUMBER: NCBI ACCESSION: NZ_NJCW01000092.1
  ref <309>: DATABASE ENTRY DATE: 2019-04-01
  ref <313>: RELEVANT RESIDUES IN SEQ ID NO: (1)..(1546)
tttaattgaagagtttgatcatggctcagattgaacgctggcggcaggcctaacacatgcaagtcgagcggtaacaggaagcagcttgctgctttgctgacgagcggcggacgggtgagtaatgtctggggatctgcccgatggagggggataaccactggaaacggtggctaataccgcataacctctgaggagcaaagtgggggaccttcgggcctcacgccatcggatgaacccagatgggattagctagtaggtggggtaacggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcgtgaagtcgaatacacttcacgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggcttaacctgggaactgcatctaagactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgccgtaaacgatgtcgacttggaggttgtggccttgagccgtggcttccggagctaacgcgttaagtcgaccgcctggggagtacggtcgcaagattaaaactcaaatgaattgacgggggcccgcacaagcggtggagcatgtggtttaattcgatgcaacgcgaagaaccttacctactcttgacatccagcgaatccttcagagatgagggagtgccttcgggaacgctgagacaggtgctgcatggctgtcgtcagctcgtgttgtgaaatgttgggttaagtcccgcaacgagcgcaacccttatcctttgttgccagcacatcatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaa

SEQ ID NO: 10087 - DNA, 1546 bp, Xenorhabdus sp. KK7.4
  ref <308>: DATABASE ACCESSION NUMBER: NCBI ACCESSION: NZ_NJAH01000096.1
  ref <309>: DATABASE ENTRY DATE: 2019-04-01
  ref <313>: RELEVANT RESIDUES IN SEQ ID NO: (1)..(1546)
tttaattgaagagtttgatcatggctcagattgaacgctggcggcaggcctaacacatgcaagtcgagcggtaacaggaagcagcttgctgctttgctgacgagcggcggacgggtgagtaatgtctggggatctgcccgatggagggggataaccactggaaacggtggctaataccgcatgacctcttgggagcaaagtgggggaccttcgggcctcacgccatcggatgaacccagatgggattagctagtaggtggggtaacggctcacctaggcgacgatccctagctggtctgagaggatgaccagccacactgggactgagacacggcccagactcctacgggaggcagcagtggggaatattgcacaatgggcgcaagcctgatgcagccatgccgcgtgtatgaagaaggccttcgggttgtaaagtactttcagcggggaggaaggcgtgaaaccgaatacgtttcacgattgacgttacccgcagaagaagcaccggctaactccgtgccagcagccgcggtaatacggagggtgcaagcgttaatcggaattactgggcgtaaagcgcacgcaggcggtcaattaagttagatgtgaaatccccgggcttaacctgggaactgcatctaagactggttgactagagtctcgtagaggggggtagaattccacgtgtagcggtgaaatgcgtagagatgtggaggaataccggtggcgaaggcggccccctggacgaagactgacgctcaggtgcgaaagcgtggggagcaaacaggattagataccctggtagtccacgccgtaaacgatgtcgacttggaggttgtggccttgagccgtggcttccggagctaacgcgttaagtcgaccgcctggggagtacggtcgcaagattaaaactcaaatgaattgacgggggcccgcacaagcggtggagcatgtggtttaattcgatgcaacgcgaagaaccttacctactcttgacatccagcgaatccttcagagatgagggagtgccttcgggaacgctgagacaggtgctgcatggctgtcgtcagctcgtgttgtgaaatgttgggttaagtcccgcaacgagcgcaacccttatcctttgttgccagcacgtgatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaa

SEQ ID NO: 10088 - DNA, 850 bp, Xenorhabdus stockiae
  ref <308>: DATABASE ACCESSION NUMBER: NCBI ACCESSION: NZ_NJAJ01000125.1
  ref <309>: DATABASE ENTRY DATE: 2019-04-01
  ref <313>: RELEVANT RESIDUES IN SEQ ID NO: (1)..(850)
aatgcgtagagatgtggaggaataccggtggcgaaggcggccccctggacgaagactgacgctcaggtgcgaaagcgtggggagcaaacaggattagataccctggtagtccacgccgtaaacgatgtcgacttggaggttgtggccttgagccgtggcttccggagctaacgcgttaagtcgaccgcctggggagtacggtcgcaagattaaaactcaaatgaattgacgggggcccgcacaagcggtggagcatgtggtttaattcgatgcaacgcgaagaaccttacctactcttgacatccagcgaacctttcagagatgaaggggtgccttcgggaacgctgagacaggtgctgcatggctgtcgtcagctcgtgttgtgaaatgttgggttaagtcccgcaacgagcgcaacccttatcctttgttgccagcacatcatggtgggaactcaagggagactgccggtgataaaccggaggaaggtggggatgacgtcaagtcatcatggcccttacgagtagggctacacacgtgctacaatggcagatacaaagagaagcgacctcgcgagagcaagcggaactcataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaa

SEQ ID NO: 10089 - DNA, 1469 bp, Xinfangfangia sp. CIP 111625
  ref <308>: DATABASE ACCESSION NUMBER: NCBI ACCESSION: NZ_UXAW01000020.1
  ref <309>: DATABASE ENTRY DATE: 2019-04-01
  ref <313>: RELEVANT RESIDUES IN SEQ ID NO: (1)..(1469)
caacttgagagtttgatcctggctcagaatgaacgctggcggcaggcctaacacatgcaagtcgagcgcgcccttcggggtgagcggcggacgggtgagtaacgcgtgggaacgtgcccttctctacggaatagtctcgggaaactgggggtaataccgtatacgcccttcgggggaaagatttatcggagaaggatcggcccgcgttggattaggtagttggtggggtaatggctcaccaagccgacgatccatagctggtttgagaggatgaccagccacactgggactgagacacggcccagactcctacgggaggcagcagtggggaatcttagacaatgggcgcaagcctgatctagccatgccgcgtgagcgatgaaggccttagggttgtaaagctctttcgctggggaagataatgactgtacccagtaaagaagccccggctaactccgtgccagcagccgcggtaatacggagggggctagcgttattcggaattactgggcgtaaagcgcacgtaggcggaccagaaagtcaggggtgaaatcccggggctcaaccccggaactgcccttgaaactcctggtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacaggattagataccctggtagtccacgccgtaaacgatgaatgccagacgtcgggcagcatgctgttcggtgtcacacctaacggattaagcattccgcctggggagtacggccgcaaggttaaaactcaaaggaattgacgggggcccgcacaagcggtggagcatgtggtttaattcgaagcaacgcgcagaaccttaccaacccttgacatgtgtatcgcggttccagagatggttccttcagttcggctggatacaacacaggtgctgcatggctgtcgtcagctcgtgtcgtgagatgttcggttaagtccggcaacgagcgcaacccacactttcagttgccatcattcagttgggcactctgaaagaactgccggtgataagccggaggaaggtgtggatgacgtcaagtcctcatggcccttacgggttgggctacacacgtgctacaatggtggtgacaatgggttaatcccaaaaagccatctcagttcggattggggtctgcaactcgaccccatgaagtcggaatcgctagtaatcgcgtaacagcatgacgcggtgaatacgttcccgggccttgtacacaccgcccgtcacaccatgggaattgggtttacccgacggccgtgcgctaaccagtaatggaggcagcggaccacggtaggctcagtgactggggtgaagtcgtaacaaggtagccgtaggggaacctgcggctggatcacctcctttctaa

SEQ ID NO: 10090 - DNA, 1527 bp, Xylanibacterium sp. 2JSPR-7
  ref <308>: DATABASE ACCESSION NUMBER: NCBI ACCESSION: NZ_CP035495.1
  ref <309>: DATABASE ENTRY DATE: 2019-04-01
  ref <313>: RELEVANT RESIDUES IN SEQ ID NO: (1)..(1527)
tttacggagagtttgatcctggctcaggacgaacgctggcggcgtgcttaacacatgcaagtcgaacggtgaagcccttcggggtggatcagtggcgaacgggtgagtaacacgtgagcaacctgcccttcacttcgggataagccttggaaacggggtctaataccggatatgagccttgcctgcatgggtggggttggaaagtttttcggtgagggatgggctcgcggcctatcagcttgttggtggggtgatggcctaccaaggcttcgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgagagtgacggtacctgcagaagaagcgccggctaactacgtgccagcagccgcggtaatacgtagggcgcaagcgttgtccggaattattgggcgtaaagagctcgtaggcggtctgtcgcgtctggtgtgaaatcccgaggctcaacctcgggcttgcatcgggtacgggcggactagagtgctgtaggggagactggaattcctggtgtagcggtggaatgcgcagatatcaggaggaacaccgatggcgaaggcaggtctctgggcagttactgacgctgaggagcgaaagcatggggagcgaacaggattagataccctggtagtccatgccgtaaacgttgggcactaggtgtgggggccattccacggttcccgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgcaccggaaactgccagagatggtggccccgtaaggtcggtgcacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggtggggatgacgtcaaatcatcatgccccttatgtcttgggcttcacgcatgctacaatggccggtacagagggctgcgataccgcaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagcccatggcccaaccaccttgtgtggggggagtggtcgaaggtgggactggcgattgggactaagtcgtaacaaggtagccgtaccggaaggtgcggctggatcacctcctttctaaggag

SEQ ID NO: 10091 - DNA, 1524 bp, Xylanimicrobium sp. FW10M-9
  ref <308>: DATABASE ACCESSION NUMBER: NCBI ACCESSION: NZ_CP035493.1
  ref <309>: DATABASE ENTRY DATE: 2019-04-01
  ref <313>: RELEVANT RESIDUES IN SEQ ID NO: (1)..(1524)
tttacggagagtttgatcctggctcaggacgaacgctggcggcgtgcttaacacatgcaagtcgaacggtgaagcccttcggggtggatcagtggcgaacgggtgagtaacacgtgagcaacctgccctccacttcgggataagccttggaaacggggtctaataccggatatgagctctgcctgcatgggtggggttggaaagtttttcggtgggggatgggctcgcggcctatcagcttgttggtggggtaatggcctaccaaggcgtcgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgtaagtgacggtacctgcagaagaagcgccggctaactacgtgccagcagccgcggtaatacgtagggcgcaagcgttgtccggaattattgggcgtaaagagctcgtaggcggtctgtcgcgtctggtgtgaaatcccgaggctcaacctcgggcttgcatcgggtacgggcaggctagagtgctgtaggggagactggaattcctggtgtagcggtggaatgcgcagatatcaggaggaacaccgatggcgaaggcaggtctctgggcagctactgacgctgaggagcgaaagcatggggagcgaacaggattagataccctggtagtccatgccgtaaacgttgggcactaggtgtgggacccattccacgggttccgtgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgaaccggaaaagtgcagagatgtgctccccgtaaggtcggttcacaggtggtgcatggttgtcgtcagctcgtgtcgtgagatgttgggttaagtcccgcaacgagcgcaaccctcgtcccatgttgccagcgggttatgccggggactcatgggagactgccggggtcaactcggaggaaggtggggatgacgtcaaatcatcatgccccttatgtcttgggcttcacgcatgctacaatggccggtacagagggctgcgataccgtaaggtggagcgaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagcccatggcccaactcgtaagagggggagtggtcgaaggtgggactggcgattgggactaagtcgtaacaaggtagccgtaccggaaggtgcggctggatcacctcctttctaaggag

SEQ ID NO: 10092 - DNA, 1467 bp, Yangia pacifica
  ref <308>: DATABASE ACCESSION NUMBER: NCBI ACCESSION: NZ_FOZW01000041.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgagaccttcgggtctagcggcggacgggtgagtaacgcgtgggaacgtgcccttctctacggaatagtcccgggaaactgggtttaataccgtatacgcccttcgggggaaagatttatcggagaaggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggggcaaccctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggatcagaaagttgggggtgaaatcccggggctcaacctcggaactgcctccaaaactcctggtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgccagagagatctggttttcacttcggtgaccgagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttctaa

SEQ ID NO: 10093 - DNA, 1467 bp, Yangia sp. CCB-MM3
  ref <308>: DATABASE ACCESSION NUMBER: NCBI ACCESSION: NZ_CP014595.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgagaccttcgggtctagcggcggacgggtgagtaacgcgtgggaacgtgcccttctctacggaacagtcccgggaaactgggtttaataccgtatacgcccttcgggggaaagatttatcggagaaggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggggcaaccctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggatcagaaagttgggggtgaaatcccggggctcaacctcggaactgcctccaaaactcctggtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcgggtagcatgctattcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccacccgagagatcgggctttcacttcggtgacctagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttctaa

SEQ ID NO: 10094 - DNA, 1467 bp, Yangia sp. SAOS 153D
  ref <308>: DATABASE ACCESSION NUMBER: NCBI ACCESSION: NZ_NTHN01000059.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgagaccttcgggtctagcggcggacgggtgagtaacgcgtgggaacgtgcccttctctacggaatagtcccgggaaactgggtttaataccgtatacgcccttcgggggaaagatttatcggagaaggatcggcccgcgttagattaggtagttggtggggtaatggcctaccaagcctacgatctatagctggtttgagaggatgatcagccacactgggactgagacacggcccagactcctacgggaggcagcagtggggaatcttagacaatgggggcaaccctgatctagccatgccgcgtgagtgatgaaggccttagggtcgtaaagctctttcgctggggaagataatgactgtacccagtaaagaaaccccggctaactccgtgccagcagccgcggtaatacggagggggttagcgttgttcggaattactgggcgtaaagcgcgcgtaggcggattggaaagttgggggtgaaatcccggggctcaacctcggaactgcctccaaaactcccagtcttgagttcgagagaggtgagtggaactccgagtgtagaggtgaaattcgtagatattcggaagaacaccagtggcgaaggcggctcactggctcgatactgacgctgaggtgcgaaagtgtggggagcaaacaggattagataccctggtagtccacaccgtaaacgatgaatgccagtcgtcggcaagcatgcttgtcggtgacacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctcggaccgccagagagatctggttttcacttcggtgaccgagtgacaggtgctgcatggctgtcgtcagctcgtgtcgtgagatgttcggttaagtccggcaacgagcgcaacccacatcttcagttgccagcagttcggctgggcactctggagaaactgcccgtgataagcgggaggaaggtgtggatgacgtcaagtcctcatggcccttacgggttgggctacacacgtgctacaatggcagtgacaatgggttaatcccaaaaaactgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcgggaggcaggcggccacggtaggatcagcgactggggtgaagtcgtaacaaggtagccgtaggggaacctgcggctggatcacctcctttctaa

SEQ ID NO: 10095 - DNA, 1546 bp, Yersinia enterocolitica
  ref <308>: DATABASE ACCESSION NUMBER: NCBI ACCESSION: NZ_LR134335.1
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcgagcggcagcgggaagtagtttactactttgccggcgagcggcggacgggtgagtaatgtctgggaaactgcctgatggagggggataactactggaaacggtagctaataccgcataacgtcttcggaccaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcataaaggttaataacctttgtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgcttcggtgccttcgggaattgtgagacaggtgctgcatggctgtcgtcagctcgtgttgtgaaatgttgggttaagtcccgcaacgagcgcaacccttatcctttgttgccagcacgtgatggtgggaactcaaaggagactgccggtgataaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 10096 - DNA, 1479 bp, Yersinia entomophaga
  ref <308>: DATABASE ACCESSION NUMBER: NCBI ACCESSION: NZ_MWTM01000058.1
  ref <309>: DATABASE ENTRY DATE: 2019-04-01
  ref <313>: RELEVANT RESIDUES IN SEQ ID NO: (1)..(1479)
ggcagcggaaagtagcttgctactttgccggcgagcggcggacgggtgagtaatgtctgggaaactgcctgatggagggggataactactggaaacggtagctaataccgcataacctcgcaagagcaaagtgggggaccttagggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcatttcacctaatacgtgaagtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacgtagcagagatgcttcggtgccttcgggaactgtgagacaggtgctgcatggctgtcgtcagctcgtgttgtgaaatgttgggttaagtcccgcaacgagcgcaacccttatcctttgttgccagcacgtcatggtgggaactcaagggagactgccggtgataaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 10097 - DNA, 1546 bp, Yersinia frederiksenii
  ref <308>: DATABASE ACCESSION NUMBER: NCBI ACCESSION: NZ_UHJA01000001.1
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcgagcggcagcgggaagtagtttactactttgccggcgagcggcggacgggtgagtaatgtctgggaaactgcctgatggagggggataactactggaaacggtagctaataccgcatgacctcgtaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggggttgagtttaatacgctcaatcattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgcttcggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgacaaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 10098 - DNA, 1546 bp, Yersinia intermedia
  ref <308>: DATABASE ACCESSION NUMBER: NCBI ACCESSION: NZ_LR134116.1
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcgagcggcagcgggaagtagtttactactttgccggcgagcggcggacgggtgagtaatgtctgggaaactgcctgatggagggggataactactggaaacggtagctaataccgcatgacctcgcaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcagtcgtgttaatagcacgattgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgcttcggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 10099 - DNA, 1551 bp, Yersinia ruckeri
  ref <308>: DATABASE ACCESSION NUMBER: NCBI ACCESSION: NZ_UHJF01000001.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcggaaagtagcttgctactttgccggcgagcggcggacgggtgagtaatgtctggggatctgcctgatggagggggataactactggaaacggtagctaataccgcataacctcgcaagagcaaagtgggggaccttcgggcctcacgccatcggatgaacccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggttaagtgttaatagcactgaacattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttggcagagatgccttggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 10100 - DNA, 1550 bp, Yersinia similis; identical to SEQ ID NO: 7454

SEQ ID NO: 10101 - DNA, 1550 bp, Yersinia similis; identical to SEQ ID NO: 7454

SEQ ID NO: 10102 - DNA, 1288 bp, Yersinia sp. 2105 StPb PI
  ref <308>: DATABASE ACCESSION NUMBER: NCBI ACCESSION: NZ_SCHO01000049.1
  ref <309>: DATABASE ENTRY DATE: 2019-04-01
  ref <313>: RELEVANT RESIDUES IN SEQ ID NO: (1)..(1288)
ggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcatttcacttaatacgtgaagtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaactgagcagagatgcttaggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 10103 - DNA, 1551 bp, Yersinia sp. CFS1934
  ref <308>: DATABASE ACCESSION NUMBER: NCBI ACCESSION: NZ_CP032487.1
  ref <309>: DATABASE ENTRY DATE: 2019-04-01
  ref <313>: RELEVANT RESIDUES IN SEQ ID NO: (1)..(1551)
aaattgaagagtttgatcatggctcagattgaacgctggcggcaggcctaacacatgcaagtcgagcggcagcgggaagtagcttgctactttgccggcgagcggcggacgggtgagtaatgtctgggaaactgcctgatggagggggataactactggaaacggtagctaataccgcatgacgtcttcggaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcataaaggttaataacctttgtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacttagcagagatgcttcggtgccttcgggaactgtgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctaaaga

SEQ ID NO: 10104 - DNA, 1546 bp, Yersinia sp. FDAARGOS 228
  ref <308>: DATABASE ACCESSION NUMBER: NCBI ACCESSION: NZ_CP020409.2
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcgagcggcagcgggaagtagtttactactttgccggcgagcggcggacgggtgagtaatgtctgggaaactgcctgatggagggggataactactggaaacggtagctaataccgcatgacctcgtaagagcaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcagtcgtgttaatagcacggttgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttagcagagatgctttagtgccttcgggaaccgtgagacaggtgctgcatggctgtcgtcagctcgtgttgtgaaatgttgggttaagtcccgcaacgagcgcaacccttatcctttgttgccagcacgtaatggtgggaactcaagggagactgccggtgacaaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 10105 - DNA, 1546 bp, Yersinia sp. IP36721
  ref <308>: DATABASE ACCESSION NUMBER: NCBI ACCESSION: NZ_QCZL01000047.1
  ref <309>: DATABASE ENTRY DATE: 2019-04-01
  ref <313>: RELEVANT RESIDUES IN SEQ ID NO: (1)..(1546)
aaattgaagagtttgatcatggctcagattgaacgctggcggcaggcctaacacatgcaagtcgagcggcagcggaaagtagcttgctactttgccggcgagcggcggacgggtgagtaatgtctgggaaactgcctgatggagggggataactactggaaacggtagctaataccgcataacctcgcaagagcaaagtgggggaccttagggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaaggcatttcacctaatacgtgaagtgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacagaacgtagcagagatgcttcggtgccttcgggaactgtgagacaggtgctgcatggctgtcgtcagctcgtgttgtgaaatgttgggttaagtcccgcaacgagcgcaacccttatcctttgttgccagcacgtcatggtgggaactcaagggagactgccggtgataaaccggaggaaggtggggatgacgtcaagtcatcatggcccttacgagtagggctacacacgtgctacaatggcagatacaaagtgaagcgaactcgcgagagcaagcggaccacataaagtctgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacct

SEQ ID NO: 10106 - DNA, 1552 bp, Yersiniaceae bacterium ZS-11
  ref <308>: DATABASE ACCESSION NUMBER: NCBI ACCESSION: NZ_SBEF01000100.1
  ref <309>: DATABASE ENTRY DATE: 2019-04-01
  ref <313>: RELEVANT RESIDUES IN SEQ ID NO: (1)..(1552)
ttaattgaagagtttgatcatggctcagattgaacgctggcggcaggcctaacacatgcaagtcgagcggtagcacaggggagcttgctccctgggtgacgagcggcggacgggtgagtaaagtctggggatctgcctgatggagggggataactactggaaacggtagctaataccgcataacgtcgcaagaccaaagtgggggaccttcgggcctcatgccattggatgaacccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcgaggaggaagggtgtttgtttaatagacgagcacattgacgttactcgcagaagaagcaccggctaactccgtgccagcagccgcggtaatacggagggtgcaagcgttaatcggaattactgggcgtaaagcgcacgcaggcggtttgtgaagtcagatgtgaaatccccgcgcttaacgtgggaacggcatttgaaactggcaagctagagtcttgtagaggggggtagaattccaggtgtagcggtgaaatgcgtagagatctggaggaataccggtggcgaaggcggccccctggacagagactgacgctcaggtgcgaaagcgtggggagcaaacaggattagataccctggtagtccacgctgtaaacgatgtcgatttggaggttgttcccttgaggagtggcttccggagctaacgcgttaaatcgaccgcctggggagtacggccgcaaggttaaaactcaaatgaattgacgggggcccgcacaagcggtggagcatgtggtttaattcgatgcaacgcgaagaaccttacctactcttgacatccacagaaggctttagagatagagctgtgcctttgggaactgtgagacaggtgctgcatggctgtcgtcagctcgtgttgtgaaatgttgggttaagtcccgcaacgagcgcaacccttatcctttgttgccaacgatttggtcgggaactcaaaggagactgccggtgataaaccggaggaaggtggggatgacgtcaagtcatcatggcccttacgagtagggctacacacgtgctacaatggcgcatacaaagagaagcgagcctgcgaggggaagcggatctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccgagaggggggcgcttaccactttgtggtccatgactggggtgaagtcgtaacaaggtaaccgtaggggaacctgcggttggatcacctccttaccttagaga

SEQ ID NO: 10107 - DNA, 1467 bp, Yoonia litorea
  ref <308>: DATABASE ACCESSION NUMBER: NCBI ACCESSION: NZ_FOZM01000007.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcactcttcggagtgagcggcggacgggttagtaacgcgtgggaatatgcccttcactacggaatagcctcgggaaactgagagtaataccgtatacgccctttgggggaaagatttatcggtgaaggattagcccgcgtctgattagatagttggtggggtaacggcctaccaagtcgacgatcagtagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagggatgataatgacagtacctggtaaagaaaccccggctaactccgtgccagcagccgcggtaatacggagggggttagcgttgttcggaattactgggcgtaaagcgcgcgtaggcggattggaaagttgggggtgaaatcccggggctcaaccccggaactgcctccaaaactatcagtctagagttcgagagaggtgagtggaattccaagtgtagaggtgaaattcgtagatatttggaggaacaccagtggcgaaggcggctcactggctcgatactgacgctgaggtgcgaaagtgtggggagcaaacaggattagataccctggtagtccacaccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctgggaccgccagagagatctggtttccacttcggtggctcagtgacaggtgctgcatggctgtcgtcagctcgtgtcgtgagatgttcggttaagtccggcaacgagcgcaacccacatccttagttgccagcagttcggctgggcactctaaggaaactgcccgtgataagcgggaggaaggtgtggatgacgtcaagtcctcatggcccttacgggttgggctacacacgtgctacaatggtgcctacagtgggttaatccccaaaaggcatctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacggccgtgcgctaaccttttggaggcagcggaccacggtaggatcagcgactggggtgaagtcgtaacaaggtagccgtaggggaacctgcggctggatcacctcctttctaa

SEQ ID NO: 10108 - DNA, 1469 bp, Yoonia maricola
  ref <308>: DATABASE ACCESSION NUMBER: NCBI ACCESSION: NZ_PGTY01000002.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcactcttcggagtgagcggcggacgggttagtaacgcgtgggaacatacccttctctacggaatagcctcgggaaactgagagtaataccgtatacgcccttcgggggaaagatttatcggagatggattggcccgcgttagattagatagttggtggggtaatggcctaccaagtctacgatctatagctggtttgagaggatgatcagcaacactgggactgagacacggcccagactcctacgggaggcagcagtggggaatcttagacaatgggcgaaagcctgatctagccatgccgcgtgagtgacgaaggccttagggtcgtaaagctctttcgccagggatgataatgacagtacctggtaaagaaaccccggctaactccgtgccagcagccgcggtaatacggagggggttagcgttgttcggaattactgggcgtaaagcgtacgtaggcggattggaaagtatggggtgaaatcccagggctcaaccctggaactgccctgtaaactatcagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcggggggcttgcccttcggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatctggttttcacttcggtgacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 10109 - DNA, 1469 bp, Yoonia maritima
  ref <308>: DATABASE ACCESSION NUMBER: NCBI ACCESSION: NZ_PVTP01000024.1
  ref <309>: DATABASE ENTRY DATE: 2019-04-01
  ref <313>: RELEVANT RESIDUES IN SEQ ID NO: (1)..(1469)
tcaacttgagagtttgatcctggctcagaacgaacgctggcggcaggcctaacacatgcaagtcgagcgcactcttcggagtgagcggcggacgggttagtaacgcgtgggaatatacccttcactacggaatagcctcgggaaactgagagtaataccgtatacgcccttcgggggaaagatttatcggtgaaggattagcccgcgtaagattagatagttggtggggtaatggcctaccaagtctacgatctttagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattggaaagttagaggtgaaatcccagggctcaaccctggaactgcctttaaaactatcagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttggaccgccagagagatctggttttctcgtaagagaccaagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 10110 - DNA, 1468 bp, Yoonia rosea; identical to SEQ ID NO: 5124
  ref <308>: DATABASE ACCESSION NUMBER: NCBI ACCESSION: NZ_FTPR01000005.1
  ref <309>: DATABASE ENTRY DATE: 2019-04-01
  ref <313>: RELEVANT RESIDUES IN SEQ ID NO: (1)..(1468)

SEQ ID NO: 10111 - DNA, 1467 bp, Yoonia sediminilitoris
  ref <308>: DATABASE ACCESSION NUMBER: NCBI ACCESSION: NZ_QPJP01000036.1
  ref <309>: DATABASE ENTRY DATE: 2019-04-01
  ref <313>: RELEVANT RESIDUES IN SEQ ID NO: (1)..(1467)
tcaacttgagagtttgatcctggctcagaacgaacgctggcggcaggcctaacacatgcaagtcgagcgcactcttcggagtgagcggcggacgggttagtaacgcgtgggaacatacccttttctacggaatagcctcgggaaactgagagtaataccgtatacgcccttcgggggaaagatttatcggagaaggattggcccgcgttagattagatagttggtggggtaacggcctaccaagtctacgatctatagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattggaaagtagggggtgaaatcccggggctcaaccccggaactgcctcctaaactatcagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatccttggaccgccagagagatctggttttctcgtaagagaccaagtgacaggtgctgcatggctgtcgtcagctcgtgtcgtgagatgttcggttaagtccggcaacgagcgcaacccacatctttagttgccagcagttcggctgggcactctagagaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaaccttcggggggcaggcggccacggtaggatcagcgactggggtgaagtcgtaacaaggtagccgtaggggaacctgcggctggatcacctcctttctaa

SEQ ID NO: 10112 - DNA, 1471 bp, Yoonia tamlensis
  ref <308>: DATABASE ACCESSION NUMBER: NCBI ACCESSION: NZ_FOYP01000003.1
  ref <309>: DATABASE ENTRY DATE: 2019-04-01
  ref <313>: RELEVANT RESIDUES IN SEQ ID NO: (1)..(1471)
tcaacttgagagtttgatcctggctcagaacgaacgctggcggcaggcctaacacatgcaagtcgagcgcttcacttcggtgaggagcggcggacgggttagtaacgcgtgggaatatacccttcactatggaatagcctcgggaaactgagagtaataccatatacgcccttcgggggaaagatttatcggtgaaggattagcccgcgtctgattagatagttggtggggtaatggcctaccaagtctacgatcagtagctggtttgagaggatgatcagcaacactgggactgagacacggcccagactcctacgggaggcagcagtggggaatcttagacaatgggcgcaagcctgatctagccatgccgcgtgagtgacgaaggccttagggtcgtaaagctctttcgccagagatgataatgacagtatctggtaaagaaaccccggctaactccgtgccagcagccgcggtaatacggagggggttagcgttgttcggaattactgggcgtaaagcgtacgtaggcggattggaaagtagggggtgaaatcccggggctcaaccccggaactgcctcctaaactatcagtctagagttcgagagaggtgagtggaattccaagtgtagaggtgaaattcgtagatatttggaggaacaccagtggcgaaggcggctcactggctcgatactgacgctgaggtacgaaagtgtggggagcaaacaggattagataccctggtagtccacaccgtaaacgatgaatgccagacgtcagggggcttgccctttggtgtcacacctaacggattaagcattccgcctggggagtacggtcgcaagattaaaactcaaaggaattgacgggggcccgcacaagcggtggagcatgtggtttaattcgaagcaacgcgcagaaccttaccaacccttgacatcctaggaccgccagagagatctggttttctcgtaagagacctagtgacaggtgctgcatggctgtcgtcagctcgtgtcgtgagatgttcggttaagtccggcaacgagcgcaacccacatccttagttgccagcagttcggctgggcactctagggaaactgcccgtgataagcgggaggaaggtgtggatgacgtcaagtcctcatggcccttacgggttgggctacacacgtgctacaatggcatctacagtgagttaatctccaaaagatgtctcagttcggattggggtctgcaactcgaccccatgaagtcggaatcgctagtaatcgcgtaacagcatgacgcggtgaatacgttcccgggccttgtacacaccgcccgtcacaccatgggagttggttctacccgacgacgctgcgctaacccttcggggaggcaggcggccacggtaggatcagcgactggggtgaagtcgtaacaaggtagccgtaggggaacctgcggctggatcacctcctttctaa

SEQ ID NO: 10113 - DNA, 1438 bp, Youngiibacter fragilis
  ref <308>: DATABASE ACCESSION NUMBER: NCBI ACCESSION: NZ_AXUN02000214.1
  ref <309>: DATABASE ENTRY DATE: 2019-04-01
  ref <313>: RELEVANT RESIDUES IN SEQ ID NO: (1)..(1438)
tttctctttagcggcggacgggtgagtaacacgtgggtaacctgcctcaaagagggggatagccttccgaaaggaagattaataccgcataatatcaggaagctgcatggcattctgatcaaaggagcaatccgctttgagatggacccgcggcgcattagctagttggtgaggtaacggcccaccaaggcgacgatgcgtagccgacctgagagggtgatcggccacattggaactgagacacggtccagactcctacgggaggcagcagtggggaatattgcacaatgggggaaaccctgatgcagcaacgccgcgtgagtgatgaaggccttcgggtcgtaaagctctttgatcagggacgataatgacggtacctgaaaaacaagccacggctaactacgtgccagcagccgcggtaatacgtaggtggcgagcgttgtccggatttactgggcgtaaagaatgcgtaggtggatatttaagtgggatgtgaaatccccgggctcaacccgggaactgcataccaaactggatatctggagtgcaggagaggaaagcggaattcctagtgtagcggtgaaatgcgtagatattaggaggaacaccagtggcgaaggcggctttctggactgtaactgacactgaggcatgaaagcgtggggagcaaacaggattagataccctggtagtccacgccgtaaactatgggtactaggtgtagggggtatcgactccccctgtgccgccgttaacacaataagtaccccgcctggggagtacggtcgcaagactaaaactcaaaggaattgacgggggcccgcacaagcagcggagcatgtggtttaattcgaagcaacgcgaagaaccttacctagacttgacatctcctgaattacccgtaactggggaagctcttcggagcaggaagacaggtggtgcatggttgtcgtcagctcgtgtcgtgagatgttgggttaagtcccgcaacgagcgcaacccttatcgttagttgctaccattaggttgagcactctagcgagactgcccgggttaaccgggaggaaggtggggatgacgtcaaatcatcatgccccttatgtctagggctacacacgtgctacaatggtgagaacaaagagaggcaagaccgcgaggtggagcaaatctcacaaaactcatcccagttcggattgcaggctgaaactcgcctgcatgaagccggagttgctagtaatcgcgaatcagcatgtcgcggtgaatacgttcccgggccttgtacacaccgcccgtcacaccatgagagttggcaatacccgaagtccgtggggtaaccttaacaggagccagcggccgaaggtagggtcagcgattggggtgaagtcgtaacaaggtagccgtaggagaacctgcggctggatcacctcctttctaggga

SEQ ID NO: 10114 - DNA, 1489 bp, Zavarzinia compransoris
  ref <308>: DATABASE ACCESSION NUMBER: NCBI ACCESSION: NZ_QGLF01000016.1
  ref <309>: DATABASE ENTRY DATE: 2019-04-01
  ref <313>: RELEVANT RESIDUES IN SEQ ID NO: (1)..(1489)
acttgagagtttgatcctggctcagaacgaacgctggcggcatgcttaacacatgcaagtcgaacgttatcttcggatggcgtggcggacgggtgagtaacacgtgggaacctgcccagaggtacgggataacccagggaaacttgggacaataccgtatgtgacctgagggtgaaagatttatcgcctttggatgggcccgcgtcggattaggtagttggtggggtaaaggcctaccaagccgacgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcacccacgacgatgatgacggtagtgggagaagaagccccggctaacttcgtgccagcagccgcggtaatacgaagggggctagcgttgttcggaatgactgggcgtaaagggcgcgtaggcggttgaccaagttgggggtgaaagcccggggcttaacctcggaattgcctccaaaactggtcggcttgagtgtggaagagggttgtggaattcccagtgtagaggtgaaattcgtagatattgggaagaacaccagtggcgaaggcgacaacctggtccattactgacgctgaggcgcgacagcgtggggagcaaacaggattagataccctggtagtccacgccgtaaacgatgagtgctggatgttggacggttgccgttcagtgtcgaagttaacgcgataagcactccgcctggggagtacggccgcaaggttgaaactcaaaggaattgacgggggcccgcacaagcggtggagcatgtggtttaattcgaagcaacgcgcagaaccttaccaacccttgacatgggaagtttgggctcgagagattgggtccttcagttcggctggcttccacacaggtgctgcatggctgtcgtcagctcgtgtcgtgagatgttgggttaagtcccgcaacgagcgcaaccctcgcctttagttgccatcatttagttgggcactctaaaggaaccgccggtgacaagccggaggaaggtggggatgacgtcaagtcctcatggcccttacgggttgggctacacacgtgctacaatggtggtgacagtgggtcgcgaggcagcgatgccaagctaatccccaaaagccacctcagttcggattgttctctgcaactcgagagcatgaaggcggaatcgctagtaatcgcggatcagcatgccgcggtgaatacgttcccgggccttgtacacaccgcccgtcacaccatgggagttggttttacccgaagccggtgcgctaaccgcaaggaggcagccgaccacggtaaggtcagcgactggggtgaagtcgtaacaaggtagccgtaggggaacctgcggctggatcacctcctttctaagg

SEQ ID NO: 10115 - DNA, 1489 bp, Zavarzinia sp. HR-AS
  ref <308>: DATABASE ACCESSION NUMBER: NCBI ACCESSION: NZ_QGLE01000031.1
  ref <309>: DATABASE ENTRY DATE: 2019-04-01
  ref <313>: RELEVANT RESIDUES IN SEQ ID NO: (1)..(1489)
acttgagagtttgatcctggctcagaacgaacgctggcggcatgcttaacacatgcaagtcgaacgttaccttcgggtggcgtggcggacgggtgagtaacacgtgggaacctgcccagaggtacgggataacccagggaaacttgggacaataccgtatgtgacctgagggtgaaagatttatcgcctttggatgggcccgcgtcggattaggtagttggtggggtaaaggcctaccaagccgacgatccgtagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctctttcgcacgcgacgatgatgacggtagcgtgagaagaagccccggctaacttcgtgccagcagccgcggtaatacgaagggggctagcgttgttcggaatgactgggcgtaaagggcgcgtaggcggttgatcaagttgggggtgaaagcccggggcttaacctcggaattgccttcaagactggtcagctagagtgtggaagagggttgtggaattcccagtgtagaggtgaaattcgtagatattgggaagaacaccagtggcgaaggcgacaacctggtccattactgacgctgaggcgcgacagcgtggggagcaaacaggattagataccctggtagtccacgccgtaaacgatgagtgctggatgttggacggttgccgttcagtgtcgaagttaacgcgataagcactccgcctggggagtacggccgcaaggttgaaactcaaaggaattgacgggggcccgcacaagcggtggagcatgtggtttaattcgaagcaacgcgcagaaccttaccaacccttgacatgggaagtttgggctcgggagactgggtccttcagttcggctggcttccacacaggtgctgcatggctgtcgtcagctcgtgtcgtgagatgttgggttaagtcccgcaacgagcgcaaccctcgcctttagttgccatcattcagttgggcactctaaaggaaccgccggtgacaagccggaggaaggtggggatgacgtcaagtcctcatggcccttacgggttgggctacacacgtgctacaatggtggtgacagtgggctgcgaggcagcgatgccaagctaatccccaaaagccacctcagttcggattgttctctgcaactcgagagcatgaaggcggaatcgctagtaatcgcggatcagcatgccgcggtgaatacgttcccgggccttgtacacaccgcccgtcacaccatgggagttggttttacccgaagccggtgcgctaaccgcaaggaggcagccgaccacggtaaggtcagcgactggggtgaagtcgtaacaaggtagccgtaggggaacctgcggctggatcacctcctttctaagg

SEQ ID NO: 10116 - DNA, 1536 bp, Zetaproteobacteria bacterium
  ref <308>: DATABASE ACCESSION NUMBER: NCBI ACCESSION: NZ_RCFQ01000057.1
  ref <309>: DATABASE ENTRY DATE: 2019-04-01
  ref <313>: RELEVANT RESIDUES IN SEQ ID NO: (1)..(1536)
tggagagtttgatcctggctcagaacgaacgctggcggcgtgcctaacacatgcaagtcgaacggtaacagtccttcgggagctgacgagtggcgcacgggtgagtaacgcgtggatatctgcctattagtgggggacaactacaggaaactgtagctaataccgcataatctctacggaggaaagcaggggacctttcggggccttgcgctgatagatgagtccgcgtcagattagctagttggtggggtaaaggcctaccaaggcgatgatctgtaactggtttgagaggatgatcagtcacactggaactgagacacggtccagacttctacggaaggcagcagtggggaatattgcacaatgggggaaaccctgatgcagcgacgccgcgtgcgggaagaaggccttcgggttgtaaaccgctttcaattgggaagaagagaagcgtactaatattgcgctgatttgacggtacctttagaagaagcaccggctaatttcgtgccagcagccgcggtaatacgaaaggtgcaagcgttgttcggatttactgggcgtaaagagatcgtaggtggtttgttaagtcggatgtgaaatcccggggctcaaccccggaactgcatccgatactggcaggctagagtttgggaggggtaagcggaattccgtgtgtagcagtgaaatgcgtagatatacggaggaacacctgaggcgaaggcggcttactggaccaatactgacactgaggatcgaaagcgtgggtagcaaacaggattagataccctggtagtccacgccctaaacgatgtcaactagccgttgcgggtatcgacccctgcagtggcgaagctaacgcgataagttgaccgcctggggagtacggtcgcaagattaaaactcaaaggaattgacgggggcccgcacaagcggtggagcatgtggtttaattcgacgcaacgcgaagaaccttacctgggtttgacatccttagaatactttagagatagagtagtgccttcgggagctaagtgacaggtgctgcatggctgtcgtcagctcgtgtcgtgagatgttgggttaagtcccgcaacgagcgcaacccctattgttagttgccatcattaagttgggcactctagcgagactgccggtgacaaaccggaggaaggtggggacgacgtcaagtcatcatggcccttatgtccagggctacacacgtgctacaatggcagatacagcgagccgcaataccgcgaggtggagctaatctcgaaaatctgtctcagttcggattgaagtctgcaactcgacttcatgaagttggaatcgctagtaatcgcggatcagcatgccgcggtgaatacgttcccgggccttgtacacaccgcccgtcacaccatgggaattggttgcaccagaagccgccgggctaacctttcggggaggcaggcgtctacggtgtggtcggtaactggggtgaagtcgtaacaaggtatccgtaccggaaggtgcggatggatcacctccttttag

SEQ ID NO: 10117 - DNA, 1537 bp, Zhongshania sp. DSW25-10
  ref <308>: DATABASE ACCESSION NUMBER: NCBI ACCESSION: NZ_RHGB01000037.1
  ref <309>: DATABASE ENTRY DATE: 2019-04-01
  ref <313>: RELEVANT RESIDUES IN SEQ ID NO: (1)..(1537)
taaactgaagagtttgatcatggctcagattgaacgctggcggcaggcctaacacatgcaagtcgagcgcgaaagtccttcgggatgagtaaagcggcggacgggtgagtaacgcgtgggaatctacctagtagtgggggacaacagccggaaacggctgctaataccgcatacgccctacgggggaaaggaggggatcttcggacctttcgctattagatgagcccgcgttagattagctagttggtagggtaaaggcctaccaaggcgacgatctatagctggtctgagaggatgatcagccacactgggactgagacacggcccagactcctacgggaggcagcagtggggaatattgcgcaatgggcgaaagcctgacgcagccatgccgcgtgtgtgaagaaggccttagggttgtaaagcactttcaatggggaggaaaggttgtaagctaataccttgcaactgtgacgttacccatacaagaagcaccggctaactccgtgccagcagccgcggtaatacggagggtgcaagcgttaatcggaattactgggcgtaaagcgcgcgtaggcggatttgtcagtcagatgtgaaagccctgggctcaacctaggaattgcatttgatactgcgagtctagagtatggtagaggtgagtggaattccaggtgtagcggtgaaatgcgtagatatctggaggaacatcagtggcgaaggcgactcactggatcaatactgacgctgaggtgcgaaagcgtggggagcaaacaggattagataccctggtagtccacgccgtaaacgatgtctactagccgttggggaacttgattctttagtggcgcagctaacgcactaagtagaccgcctggggagtacggccgcaaggttaaaactcaaatgaattgacgggggcccgcacaagcggtggagcatgtggtttaattcgatgcaacgcgaagaaccttaccaggtcttgacatcccgagaagtcgctagagatagcttcgtgccttcgggaactcggtgacaggtgctgcatggctgtcgtcagctcgtgtcgtgagatgttgggttaagtcccgtaacgagcgcaacccttgtcctttgttgccagcgcgtaatggcgggaactcaaaggagactgccggtgacaaaccggaggaaggtggggacgacgtcaagtcatcatggcccttacgacctgggctacacacgtgctacaatggccggtacagagggctgcaataccgcgaggtggagctaatcccttaaaaccggtcgtagtccggattggagtctgcaactcgactccatgaagtcggaatcgctagtaatcgcgaatcagaatgtcgcggtgaatacgttcccgggccttgtacacaccgcccgtcacaccatgggagtggattgcaccagaagtggttagcctaaccgtaaggggggcgatcaccacggtgtggttcatgactggggtgaagtcgtaacaaggtagccctaggggaacctggggctggatcacctccttaaa

SEQ ID NO: 10118 - DNA, 1537 bp, Zhongshania sp. ZX-21
  ref <308>: DATABASE ACCESSION NUMBER: NCBI ACCESSION: NZ_PQGG01000010.1
  ref <309>: DATABASE ENTRY DATE: 2019-04-01
  ref <313>: RELEVANT RESIDUES IN SEQ ID NO: (1)..(1537)
taaactgaagagtttgatcatggctcagattgaacgctggcggcaggcctaacacatgcaagtcgagcgcgaaagtccttcgggatgagtaaagcggcggacgggtgagtaacgcgtgggaatctacctagtagtgggggacaacagccggaaacggctgctaataccgcatacgccctacgggggaaaggaggggatcttcggacctttcgctattagatgagcccgcgttagattagctagttggtagggtaagagcctaccaaggcgacgatctatagctggtctgagaggatgatcagccacactgggactgagacacggcccagactcctacgggaggcagcagtggggaatattgcgcaatgggcgaaagcctgacgcagccatgccgcgtgtgtgaagaaggccttagggttgtaaagcactttcaatggggaggaaaggttgtaagctaataccttgcagctgtgacgttacccatacaagaagcaccggctaactccgtgccagcagccgcggtaatacggagggtgcaagcgttaatcggaattactgggcgtaaagcgcgcgtaggcggatttgtcagtcagatgtgaaagccctgggctcaacctaggaattgcatttgatactgcgagtctagagtatggtagaggtgagtggaattccaggtgtagcggtgaaatgcgtagatatctggaggaacatcagtggcgaaggcgactcactggatcaatactgacgctgaggtgcgaaagcgtggggagcaaacaggattagataccctggtagtccacgccgtaaacgatgtctactagccgttggggaacttgattctttagtggcgcagctaacgcactaagtagaccgcctggggagtacggccgcaaggttaaaactcaaatgaattgacgggggcccgcacaagcggtggagcatgtggtttaattcgatgcaacgcgaagaaccttaccaggtcttgacatcccgagaagtcgctagagatagcttcgtgccttcgggaactcggtgacaggtgctgcatggctgtcgtcagctcgtgtcgtgagatgttgggttaagtcccgtaacgagcgcaacccttgtcctttgttgccagcgcgtaatggcgggaactcaaaggagactgccggtgacaaaccggaggaaggtggggacgacgtcaagtcatcatggcccttacgacctgggctacacacgtgctacaatggccggtacagagggctgcaataccgcgaggtggagctaatcccttaaaaccggtcgtagtccggattggagtctgcaactcgactccatgaagtcggaatcgctagtaatcgcgaatcagaatgtcgcggtgaatacgttcccgggccttgtacacaccgcccgtcacaccatgggagtggattgcaccagaagtggttagcctaaccgtaaggggggcgatcaccacggtgtggttcatgactggggtgaagtcgtaacaaggtagccctaggggaacctggggctggatcacctccttaaa

SEQ ID NO: 10119 - DNA, 1296 bp, Zimmermannella sp. YIM 102482-1
  ref <308>: DATABASE ACCESSION NUMBER: NCBI ACCESSION: NZ_RQVS01000034.1
  ref <309>: DATABASE ENTRY DATE: 2019-04-01
  ref <313>: RELEVANT RESIDUES IN SEQ ID NO: (1)..(1296)
tttacggagagtttgatcctggctcaggacgaacgctggcggcgtgcttaacacatgcaagtcgaacgatgaagccccgcttgcggggtggattagtggcgaacgggtgagtaatacgtgagcaacgtgcccagaactctggaataacttcgggaaaccgtggctaatactggatatgtgccggggaggcatctcctccggttggaaagatttatcggttctggatcggctcacggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaagcccgaggctcaacctcgggtctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagcatggggagcgaacaggattagataccctggtagtccatgccgtaaacgttgggcgctagatgtggggaccattccacggtttccgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatataccggacatggccagagatggtcactccctttgggtcggtatacaggtggtgcatggttgtcgtcagctcgtgtcgtgagatgttcggttaagtccggcaacgagcgcaaccctcgtcctatgttgccagcacgttatggtgggaactcatgggatactgccgtggtcaacacggaggaaggtggggatgacgtcaaatcatcatgccccttatgtcttgggcttcacgcatgctacaatggccggtacaatgggctgcgataccgcgaggtggagcgaatcccaaaaagccggtctcagttcggattggggtctgca

SEQ ID NO: 10120 - DNA, 1549 bp, Zobellella maritima
  ref <308>: DATABASE ACCESSION NUMBER: NCBI ACCESSION: NZ_QCZE01000010.1
  ref <309>: DATABASE ENTRY DATE: 2019-04-01
  ref <313>: RELEVANT RESIDUES IN SEQ ID NO: (1)..(1549)
ttaattgaagagtttgatcatggctcagattgaacgctggcggcaggcctaacacatgcaagtcgagcggtaacagggggtagcttgctactctgctgacgagcggcggacgggtgagtaaggcttgggtatctgcccagtcgagggggataacagttggaaacgactgctaataccgcatacgccctacgggggaaagcaggggatcttcggaccttgcgcgattggatgagcccaagtgagattagctagttggtgaggtaatggctcaccaaggcgacgatctctagctggtctgagaggatgaccagccacactgggactgagacacggcccagactcctacgggaggcagcagtggggaatattgcacaatgggggaaaccctgatgcagccatgccgcgtgtgtgaagaaggccttcgggttgtaaagcactttcagtggtgaggaaggaagtaaggttaatacccttgcttattgacgttagccacagaagaagcaccggctaactccgtgccagcagccgcggtaatacggagggtgcaagcgttaatcggaattactgggcgtaaagcgcacgcaggcggtttgttaagccagatgtgaaagccccgggctcaacctgggaattgcatttggaactggcaaactagagtcttggagaggggggtagaatttccggtgtagcggtgaaatgcgtagagatcggaaggaataccagtggcgaaggcggccccctggccaaagactgacgctcaggtgcgaaagcgtggggagcaaacaggattagataccctggtagtccacgctgtaaacgatgtcaacttggagtctgtgccgtttgagcgcgggttccggagctaacgcgttaagttgaccgcctggggagtacggccgcaaggttaaaactcaaatgaattgacgggggcccgcacaagcggtggagcatgtggtttaattcgatgcaacgcgaagaaccttacctacccttgacatacagcgaagttttcagagatgaattcgtgccttcgggaacgctgatacaggtgctgcatggctgtcgtcagctcgtgtcgtgagatgttgggttaagtcccgcaacgagcgcaacccttgtcctttgttgccagcgattcggtcgggaactcaaaggagactgccggtgataaaccggaggaaggtggggacgacgtcaagtcatcatggcccttacgggtagggctacacacgtgctacaatggcgcgtacagagggcggcgaacctgcgaaggtaagcgaatcccaaaaagcgcgtcgtagtccggatcggagtctgcaactcgactccgtgaagtcggaatcgctagtaatcgcaaatcagaatgttgcggtgaatacgttcccgggccttgtacacaccgcccgtcacaccatgggagtgggttgctccagaagtagatagcttaaccttcgggagggcgtttaccacggagtgattcatgactggggtgaagtcgtaacaaggtaaccgtaggggaacctgcggttggatcacctccttaccttaa

SEQ ID NO: 10121 - DNA, 1528 bp, Zobellia sp. OII3
  ref <308>: DATABASE ACCESSION NUMBER: NCBI ACCESSION: NZ_MWRZ01000026.1
  ref <309>: DATABASE ENTRY DATE: 2019-04-01
  ref <313>: RELEVANT RESIDUES IN SEQ ID NO: (1)..(1528)
caacgatgaagagtttgatcctggctcaggatgaacgctagcggcaggcctaacacatgcaagtcgaggggtaacatggtagcttgctaccgatgacgaccggcgcacgggtgcgcaacgcgtatacaatctgccccctactgtgggatagcccagagaaatttggattaataccacatggtaccatattacggcatcgtatttatggttaaaggttacggtaggggatgagtatgcgtcccattagttagttggtgaggtaacggctcaccaagaccgcgatgggtaggggccctgagagggggatcccccacactggtactgagacacggaccagactcctacgggaggcagcagtgaggaatattggacaatgggcgggagcctgatccagccatgccgcgtgcaggaagaatgccctatgggtagtaaactgcttttatacgggaagaaaaagggctacgtgtagcccactgacggtaccgtaagaataaggaccggctaactccgtgccagcagccgcggtaatacggagggtccgagcgttatccggaattattgggtttaaagggtccgtaggcgggccgataagtcaggggtgaaagtttgcagctcaactgtaaaattgcctttgatactgtcggtcttgagttatagtgaagttgccggaatatgtagtgtagcggtgaaatgcatagatattacatagaacaccgattgcgaaggcaggtgactaactatatactgacgctgatggacgaaagcgtggggagcgaacaggattagataccctggtagtccacgccgtaaacgatggatactagctgtccgggtccttgagacctgggcggccaagcgaaagtgataagtatcccacctggggagtacgttcgcaagaatgaaactcaaaggaattgacgggggcccgcacaagcggtggagcatgtggtttaattcgatgatacgcgaggaaccttaccagggcttaaatgcattttgacaggggtagagataccttttccttcgggcaatttgcaaggtgctgcatggttgtcgtcagctcgtgccgtgaggtgtcaggttaagtcctataacgagcgcaacccctaccgttagttgccagcgagtcatgtcggggactctaacgggactgccggtgcaaaccgtgaggaaggtggggacgacgtcaaatcatcacggcccttacgtcctgggccacacacgtgctacaatggccggtacagcgggaagccatgcggcaacgcagagcggatccacaaaaccggtcacagttcggatcggggtctgcaactcgaccccgtgaagctggaatcgctagtaatcggatatcagccatgatccggtgaatacgttcccgggccttgtacacaccgcccgtcaagccatggaagccgggagtgcctgaagtccgtcaccgcaaggagcggcctagggcaagatcggtaactagggctaagtcgtaacaaggtagccgtaccggaaggtgcggctggaacacctcctttct

SEQ ID NO: 10122 - DNA, 1542 bp, Zoogloeaceae bacteirum Par-f-2
  ref <308>: DATABASE ACCESSION NUMBER: NCBI ACCESSION: NZ_CP028425.1
  ref <309>: DATABASE ENTRY DATE: 2019-04-01
  ref <313>: RELEVANT RESIDUES IN SEQ ID NO: (1)..(1542)
tgaacttaagagtttgatcctggctcagattgaacgctggcggcatgctttacacatgcaagtcgaacggcagcgggggcttcggcctgccggcgagtggcgaacgggtgagtaatgcatcggaacgtacccagtggtgggggatagctcggcgaaagccggattaataccgcatacgccctgagggggaaagtgggggatcttcggacctcacgccattggagcggccgatgtcggattagctagttggtgaggtaaaggctcaccaaggcgacgatccgtagctggtctgagaggatgatcagccacactgggactgagacacggcccagactcctacgggaggcagcagtggggaattttggacaatgggcgcaagcctgatccagccatgccgcgtgagtgaagaaggccttcgggttgtaaagctctttcagtcgggaagaaaaggcgggctctaacatagcctgttgctgacggtaccgacagaagaagcaccggctaactacgtgccagcagccgcggtaatacgtagggtgcgagcgttaatcggaattactgggcgtaaagcgtgcgcaggcggtttgctaagacaggtgtgaaatccccgggcttaacctgggaactgcgcttgtgactggcaggctagagtacggcagaggggggtggaattccacgtgtagcagtgaaatgcgtagagatgtggaggaacaccgatggcgaaggcagccccctgggcctgtactgacgctcatgcacgaaagcgtggggagcaaacaggattagataccctggtagtccacgccctaaacgatgtcaactagtcgttcggagcggtaacgcactgagtgacgcagctaacgcgtgaagttgaccgcctggggagtacggccgcaaggttaaaactcaaaggaattgacggggacccgcacaagcggtggatgatgtggattaattcgatgcaacgcgaaaaaccttacctacccttgacatgccaggaatcttggtgagagccgagagtgccttcgggagcctggacacaggtgctgcatggctgtcgtcagctcgtgtcgtgagatgttgggttaagtcccgcaacgagcgcaacccttgccactaattgccatcattgagttgggcactttagtgggactgccggtgacaaaccggaggaaggtggggatgacgtcaagtcctcatggcccttatgggtagggcttcacacgtcatacaatggtcggtacagagggttgccaagccgcgaggcggagccaatccctacaaagccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggtttcaccagaagtaggtagcttaaccttcgggagggcgcttaccacggtgagattcatgactggggtgaagtcgtaacaaggtagccgtatcggaaggtgcggctggatcacctcctttcaag

SEQ ID NO: 10123 - DNA, 1542 bp, Zooshikella ganghwensis
  ref <308>: DATABASE ACCESSION NUMBER: NCBI ACCESSION: NZ_NDXW01000001.1
  ref <309>: DATABASE ENTRY DATE: 2019-04-01
  ref <313>: RELEVANT RESIDUES IN SEQ ID NO: (1)..(1542)
aaactgaagagtttgatcatggctcagattgaacgctggcggcaggcctaacacatgcaagtcgggcggtaacaggagagcttgctctcgctgacgagcggcggacgggtgagtaacgcataggaatctgcccatgggtgggggatagcccggagaaatccggattaataccgcatatgccctgaggggtaaagcaggggatcttaggaccttgcgccgatggatgagcctatgtcggattagctagttggtagggtaaaggcctaccaaggcgacgatccgtagctggtctgagaggatgatcagccacactgggactgagacacggcccagactcctacgggaggcagcagtggggaatattggacaatgggggcaaccctgatccagccatgccgcgtgtgtgaagaaggctttcgggttgtaaagcactttcagcagggaggaaaggttgcgggttaatacctcgtagctgtgacgttacctgcagaagaagcaccggctaactccgtgccagcagccgcggtaatacggagggtgcaagcgttaatcggaattactgggcgtaaagcgtgcgtaggcggtttactaagctggatgtgaaatccccgggcttaacctgggaactgcattcataactggtaggctagagtatggcagaggcgagtggaatttcctgtgtagcggtgaaatgcgtagatataggaaggaacaccagtggcgaaggcgactcgctgggtcaatactgacgctgaggtacgaaagcgtgggtagcaaacaggattagataccctggtagtccacgccgtaaacgatgagaactagccgttgggatccatgtaggtcttggtggcgcagctaacgcactaagttctccgcctggggagtacggccgcaaggttaaaactcaaatgaattgacgggggcccgcacaagcggtggagcatgtggtttaattcgaagcaacgcgaagaaccttacctggccttgacatcctgcgaacactttagagatagagtggtgccttcgggagcgcagagacaggtgctgcatggctgtcgtcagctcgtgtcgtgagatgttgggttaagtcccgtaacgagcgcaacccttgtccttagttaccagcatgtaatggtggggactctaaggagactgccggtgacaaaccggaggaaggtggggacgacgtcaagtcatcatggcccttacggccagggctacacacgtgctacaatggggcgaacagagggttgccaagctgcgaagtggagctaatctcttaaaacgtctcgtagtccggattggagtctgcaactcgactccatgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtaaccctaggggaacctggggttggatcacctccttaaa

SEQ ID NO: 10124 - DNA, 1543 bp, Zymobacter palmae
  ref <308>: DATABASE ACCESSION NUMBER: NCBI ACCESSION: NZ_AP018933.1
  ref <309>: DATABASE ENTRY DATE: 2019-04-01
  ref <313>: RELEVANT RESIDUES IN SEQ ID NO: (1)..(1543)
aaactgaagagtttgatcatggctcagattgaacgctggcggcaggcctaacacatgcaagtcgagcggcagcacgggaagcttgcttcctggtggcgagcggcggacgggtgagtaatgcatgggaatctgcccgatagtgggggataacgtgtggaaacgcacgctaataccgcatacgtcctacgggagaaaggaggggatcttcggacctttcgctatcggatgagcccatgttggattagctagttggtgaggtaatggctcaccaaggcaacgatccatagctggtctgagaggatgatcagccacactgggactgagacacggcccagactcctacgggaggcagcagtggggaatattggacaatgggcgaaagcctgatccagccatgccgcgtgtgtgaagaaggccttagggttgtaaagcactttcagtggggaagaaagcctgaggcctaatacgtttcaggaaggacatcacccacagaagaagcaccggctaactccgtgccagcagccgcggtaatacggagggtgcgagcgttaatcggaattactgggcgtaaagggcgcgtaggcggtctgttaagccagatgtgaaagccccgggcttaacctgggaacagcatttggaactggcagacttgagtgcaggagaggaaggtagaattccaggtgtagcggtgaaatgcgtagagatctggaggaataccagtggcgaaggcggccttctggactgacactgacgctgaggcgcgaaagcgtgggtagcaaacaggattagataccctggtagtccacgccgtaaacgatgtcaactagccgttggatcccttgaggatttagtggcgcagctaacgcactaagttgaccgcctggggagtacggtcgcaagactaaaactcaaatgaattgacgggggcccgcacaagcggtggagcatgtggtttaattcgatgcaacgcgaagaaccttacctactcttgacatccagagaactttccagagatggatgggtgccttcgggaactctgagacaggtgctgcatggctgtcgtcagctcgtgttgtgaaatgttgggttaagtcccgtaacgagcgcaacccctatccttatttgccagcgattcggtcgggaactctaaggagactgccggtgacaaaccggaggaaggtggggacgacgtcaagtcatcatggcccttacgagtagggctacacacgtgctacaatgacgagtacagagggttgcgaagcggcgacgtgaagctaatcccagaaagctcgcctcagtccggatcggagtctgcaactcgactccgtgaagtcggaatcgctagtaatcgcgaatcagaatgtcgcggtgaatacgttcccgggccttgtacacaccgcccgtcacaccatgggagtggattgcaccagaagtggctagtttaaccttcgggaaaacggttaccacggtgtggttcatgactggggtgaagtcgtaacaaggtagccgtaggggaacctgcggctggatcacctccttaaac

SEQ ID NO: 10125 - DNA, 1491 bp, Zymomonas mobilis
  ref <308>: DATABASE ACCESSION NUMBER: NCBI ACCESSION: NZ_CP035712.1
  ref <309>: DATABASE ENTRY DATE: 2019-04-01
  ref <313>: RELEVANT RESIDUES IN SEQ ID NO: (1)..(1491)
aacttgagagtttgattctggctcagaacgaacgctggcggcatgcttaacacatgcaagtcgaacgaaggcttcggccttagtggcgcacgggtgcgtaacgcgtgggaatctgccttcaggtacggaataactaggggaaactcgagctaataccgtatgatatcgagagatcaaagatttatcgcctgaagatgagcccgcgttggattagctagttggtagggtaaaggcttaccaaggcgacgatccatagctggtctgagaggatgatcagccacactgggactgagacacggcccagactcctacgggaggcagcagtggggaatattggacaatgggggaaaccctgatccagcaatgccgcgtgagtgaagaaggccttagggttgtaaagctcttttacccgggatgataatgacagtaccgggagaataagctccggctaactccgtgccagcagccgcggtaatacggagggagctagcgttgttcggaattactgggcgtaaagcgtacgtaggcggtttaataagtcaggggtgaaagcccagagctcaactctggaactgcctttgagactgttagactagaacatagaagaggtaagtggaattccgagtgtagaggtgaaattcgtagatattcggaagaacaccagtggcgaaggcgacttactggtctatagttgacgctgaggtacgaaagcgtgggtagcaaacaggattagataccctggtagtccacgccgtaaacgatgataactagctgtccgggtacatggtatctgggtggcggagctaacgcattaagttatccgcctggggagtacggtcgcaagattaaaactcaaagaaattgacgggggcctgcacaagcggtggagcatgtggtttaattcgaagcaacgcgcagaaccttaccagcgtttgacatcctgatcgcggaaagtggagacacattctttcagttcggctggatcagagacaggtgctgcatggctgtcgtcagctcgtgtcgtgagatgttgggttaagtcccgcaacgagcgcaaccctcacctctagttgccatcattaagttgggcactttagaggaactgccggtgataagccggaggaaggtggggatgacgtcaagtcctcatggcccttacgcgctgggctacacacgtgctacaatggcggtgacagagggccgcaagcctgcaaaggttagctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgcgctaacccgcaagggaggcaggcgaccacggtgggtttagcgactggggtgaagtcgtaacaaggtagccgtaggggaacctgcggctggatcacctcctttcta

SEQ ID NO: 10126 - DNA, 1552 bp, [Brevibacterium] frigoritolerans
ttcggagagtttgatcctggctcaggacgaacgctggcggcgtgcctaatacatgcaagtcgagcgaatcgacgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctttcta

SEQ ID NO: 10127 - DNA, 1551 bp, [Brevibacterium] frigoritolerans
ttcggagagtttgatcctggctcaggacgaacgctggcggcgtgcctaatacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaggtgggacagatgattggggtgaagtcgtaacaaggtagccgtatcggaaggtgcggctggatcacctcctttct

SEQ ID NO: 10128 - DNA, 1551 bp, [Haemophilus] piscium; identical to SEQ ID NO: 1138

SEQ ID NO: 10129 - DNA, 1519 bp, Arcobacter porcinus
  ref <308>: DATABASE ACCESSION NUMBER: NCBI ACCESSION: NZ_LCUI01000002.1
  ref <309>: DATABASE ENTRY DATE: 2019-04-01
  ref <313>: RELEVANT RESIDUES IN SEQ ID NO: (1)..(1519)
tttatggagagtttgatcctggctcagagtgaacgctggcggcgtgcttaacacatgcaagtcgaacgagaacgggctatagcttgctatagttgtcagctaagtggcgcacgggtgagtaatgtataggtaatatgccttttactaagggataacagttggaaacgactgctaataccttatattccttttcaacataagttgataagggaaagatttattggtaagagattagcctgtattgtatcagttagttggtggggtaatggctcaccaagacaatgacgcataactggtttgagaggatgatcagtcacactggaactgagacacggtccagactcctacgggaggcagcagtggggaatattgcacaatggacggaagtctgatgcagcaacgccgcgtggaggatgacacatttcggtgcgtaaactccttttatataagaagataatgacggtattatatgaataagcaccggctaactccgtgccagcagccgcggtaatacggggggtgcaagcgttactcggaatcactgggcgtaaagagcatgtaggcggattgataagtttgaagtgaaatcctatagcttaactatagaactgctttgaaaactgttaatctagaatgtgggagaggtagatggaatttctggtgtaggggtaaaatccgtagagatcagaaggaataccgattgcgaaggcgatctactggaacactattgacgctgagatgcgaaagcgtggggagcaaacaggattagataccctggtagtccacgccctaaacgatgtacactagttgttgtgagacttgatcttgcagtaatgcagttaacacattaagtgtaccgcctggggagtacggtcgcaagattaaaactcaaaggaatagacggggacccgcacaagcggtggagcatgtggtttaattcgacgatacgcgaagaaccttacctggacttgacatagtaagaactttcaagagattgattggtgtctgcttgcagaaacttatatacaggtgctgcacggctgtcgtcagctcgtgtcgtgagatgttgggttaagtcccgcaacgagcgcaaccctcgtgtttagttgctaacagttcggctgagaactctaaacagactgcctacgcaagtaggaggaaggtgaggacgacgtcaagtcatcatggcccttacgtccagggctacacacgtgctacaatgggatatacagtgagctgcgatacagtgatgtggagcaaatcttataaaatatctcccagttcggattgtagtctgcaactcgactacatgaagttggaatcgctagtaatcgtagatcagctatgctacggtgaatacgttcccgggtcttgtactcaccgcccgtcacaccatgggagtcgaactcattcgaagcggggatgctaaagtagctaccttccacagtggatttggcgactggggtgaagtcgtaacaaggtaaccgtaggagaacctgcggttggatcacctcctttc

SEQ ID NO: 10130 - DNA, 1560 bp, Bacillus caldolyticus
  ref <308>: DATABASE ACCESSION NUMBER: NCBI ACCESSION: NZ_CP025074.1
  ref <309>: DATABASE ENTRY DATE: 2019-04-01
  ref <313>: RELEVANT RESIDUES IN SEQ ID NO: (1)..(1560)
cttttggagagtttgatcctggctcaggacgaacgctggcggcgtgcctaatacatgcaagtcgagcggaccaaatcggagcttgctctgatttggtcagcggcggacgggtgagtaacacgtgggcaacctgcccgcaagaccgggataactccgggaaaccggagctaataccggataacaccgaagaccgcatggtctttggttgaaaggcggcctttggctgtcacttgcggatgggcccgcggcgcattagctagttggtgaggtaacggctcaccaaggcgacgatgcgtagccggcctgagagggtgaccggccacactgggactgagacacggcccagactcctacgggaggcagcagtagggaatcttccgcaatgggcgaaagcctgacggagcgacgccgcgtgagcgaagaaggccttcgggtcgtaaagctctgttgtgagggacgaaggagcgccgttcgaagagggcggcgcggtgacggtacctcacgaggaagccccggctaactacgtgccagcagccgcggtaatacgtagggggcgagcgttgtccggaattattgggcgtaaagcgcgcgcaggcggttccttaagtctgatgtgaaagcccacggctcaaccgtggagggtcattggaaactgggggacttgagtgcaggagaggagagcggaattccacgtgtagcggtgaaatgcgtagagatgtggaggaacaccagtggcgaaggcggctctctggcctgcaactgacgctgaggcgcgaaagcgtggggagcaaacaggattagataccctggtagtccacgccgtaaacgatgagtgctaagtgttagaggggtcacaccctttagtgctgcagctaacgcgataagcactccgcctggggagtacggccgcaaggctgaaactcaaaggaattgacgggggcccgcacaagcggtggagcatgtggtttaattcgaagcaacgcgaagaaccttaccaggtcttgacatcccctgacaacccaagagattgggcgttcccccttcggggggacagggtgacaggtggtgcatggttgtcgtcagctcgtgtcgtgagatgttgggttaagtcccgcaacgagcgcaaccctcgcctctagttgccagcacgaaggtgggcactctagagggactgccggcgacaagtcggaggaaggtggggatgacgtcaaatcatcatgccccttatgacctgggctacacacgtgctacaatgggcggtacaaagggctgcgaacccgcgagggggagcgaatcccaaaaagccgctctcagttcggattgcaggctgcaactcgcctgcatgaagccggaatcgctagtaatcgcggatcagcatgccgcggtgaatacgttcccgggccttgtacacaccgcccgtcacaccacgagagcttgcaacacccgaagtcggtgcggtaacccttacgggagccagccgccgaaggtggggcaagtgattggggtgaagtcgtaacaaggtagccgtaccggaaggtgcggctggatcacctcctttct

SEQ ID NO: 10131 - DNA, 1574 bp, Bacillus clarkii
  ref <308>: DATABASE ACCESSION NUMBER: NCBI ACCESSION: NZ_KV917376.1
  ref <309>: DATABASE ENTRY DATE: 2019-04-01
  ref <313>: RELEVANT RESIDUES IN SEQ ID NO: (1)..(1574)
atttattggagagtttgatcctggctcaggacgaacgctggcggcgtgcctaatacatgcaagtcgagcgcaggaaacaggctgatcccttcggggtgatgcctgtggaatgagcggcggacgggtgagtaacacgtgggcaacctgccttacagactgggataactccgggaaaccggggctaataccggatgaccagaagaaccgcatggttctgctgtaaaagttgggacttgttcctaacactgtaagatgggcccgcggcgcattagctagttggtgaggtaacggctcaccaaggcgacgatgcgtagccgacctgagagggtgatcggccacactggaactgagacacggtccagactcctacgggaggcagcagtagggaatcatccgcaatgggcgaaagcctgacggtgcaacgccgcgtgaacgatgaaggtcttcggattgtaaagttctgttgtcagggaagaacacgtgccgttcgaacagggcggcaccttgacggtacctgaccagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggggacttgagtgtaggagaggaaagtggaattccacgtgtagcggtgaaatgcgtagatatgtggaggaacaccagtggcgaaggcgactttctggcctataactgacgctgaggcgcgaaagcgtggggagcaaacaggattagataccctggtagtccacgccgtaaacgatgagtgctaggtgttaggggtttcgatacccttagtgccgcagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgacaactctggagacagagcgttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatgggtggtacaaagggcagcaaagccgcgaggccgagcgaatcccataaagccactctcagttcggattgcaggctgcaactcgcctgcatgaagccggaattgctagtaatcgcggatcagcatgccgcggtgaatacgttcccgggccttgtacacaccgcccgtcacaccacgagagcttgtaacacccgaagtcggtgaggtaaccttttggagccagccgccgaaggtgggacaggtgattggggtgaagtcgtaacaaggtatccctaccggaaggtggggatggatcacctcctttctaa

SEQ ID NO: 10132 - DNA, 1572 bp, Bacillus selenitireducens
  ref <308>: DATABASE ACCESSION NUMBER: NCBI ACCESSION: NC_014219.1
  ref <309>: DATABASE ENTRY DATE: 2019-04-01
  ref <313>: RELEVANT RESIDUES IN SEQ ID NO: (1)..(1572)
tttattggagagtttgatcctggctcaggacgaacgctggcggcatgcctaatacatgcaagtcgagcgcaggaagctttcagaagccttcgggtggacggaagtggaatgagcggcggacgggtgagtaacacgtgggcaacctgccctgcagaccgggacaacctcgtgaaaatgaggctaataccggatgaccattggcaccgcatggtgccgatgtaaaagaggggattcgtcctctcactgcaggatgggcccgcggcgcattagctagttggtgaggtaagggctcaccaaggcgacgatgcgtagccgacctgagagggtgatcggccacactgggactgagacacggcccagactcctacgggaggcagcagtagggaatcatccgcaatgggcgaaagcctgacggtgcaatgccgcgtgaacgatgaaggttctcggatcgtaaagttctgttatgagggaagaacaagtgccgtttgaataaggcggcaccttgacggtacctcacgagaaagccccggctaactacgtgccagcagccgcggtaatacgtagggggcaagcgttgtccggaattattgggcgtaaagcgcgcgcaggcggtctcttaagtctgatgtgaaagcccacggctcaaccgtggagggtcattggaaactgggagacttgagtgtaagagaggaaagtggaattccacgtgtagcggtgaaatgcgtagatatgtggaggaacaccagtggcgaaggcgactttctggcttacaactgacgctgaggcgcgaaagcgtggggagcaaacaggattagataccctggtagtccacgccgtaaacgatgagtgctaggtgttaggggtttcgatacccttagtgccgaagttaacacattaagcactccgcctggggagtacggccgcaaggctgaaactcaaaggaattgacgggggcccgcacaagcagtggagcatgtggtttaattcgaagcaacgcgaagaaccttaccaggtcttgacatcctctgaacatccaggagactggactttccccttcgggggacagagtgacaggtggtgcatggttgtcgtcagctcgtgtcgtgagatgttgggttaagtcccgcaacgagcgcaacccctgatcttagttgccagcattcagttgggcactctaaggtgactgccggtgataaaccggaggaaggtggggatgacgtcaaatcatcatgccccttatgacctgggctacacacgtgctacaatggatggtacaatgggttgcgaagccgcgaggtgaagccaatcccataaagccattctcagttcggattgcaggctgcaactcgcctgcatgaagccggaattgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtatccgtaccggaaggtgcggatggatcacctcctttctaa

SEQ ID NO: 10133 - DNA, 1563 bp, Bacillus sp. KCTC 13219
  ref <308>: DATABASE ACCESSION NUMBER: NCBI ACCESSION: NZ_LUFJ01000001.1
  ref <309>: DATABASE ENTRY DATE: 2019-04-01
  ref <313>: RELEVANT RESIDUES IN SEQ ID NO: (1)..(1563)
ttttatggagagtttgatcctggctcaggacgaacgctggcggcgtgcctaatacatgcaagtcgagcgrgygttaytttggtgcttgcaccgaagtaacgctagcggcggacgggtgagtaacacgtgggcaacctgccctgtagatggggataactccgggaaaccggggctaataccgaatgatactttgaaacmcatgttttaaagttgaaagatggytctgctatcgctacaggatgggcccgcggcgcattagctagttggtgaggtaatggctcaccaaggcaacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtgccgtagtaactggcggcaccttgacggtaccttattagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggaaggtcattggaaactggggaacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgttgcccactatggagacatggttttcccttcggggacaacggtgacaggtggtgcatggttgtcgtcagctcgtgtcgtgagatgttgggttaagtcccgcaacgagcgcaacccttgatcttagttgccatcattcagttgggcactctaaggtgactgccggtgacaaaccggaggaaggtggggatgacgtcaaatcatcatgccccttatgacctgggctacacacgtgctacaatggacggtacaaccggttgccaacccgcgagggggagctaatccgataaaaccgttctcagttcggattgtaggctgcaactcgcctacatgaagccggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggatagatgattggggtgaagtcgtaacaaggtagccgtatcggaaggtgcggctggatcacctcctttctaagga

SEQ ID NO: 10134 - DNA, 1544 bp, Bacteroides coagulans
  ref <308>: DATABASE ACCESSION NUMBER: NCBI ACCESSION: NZ_QEKV01000019.1
  ref <309>: DATABASE ENTRY DATE: 2019-04-01
  ref <313>: RELEVANT RESIDUES IN SEQ ID NO: (1)..(1544)
ttgagagtttgatcctggctcaggacgaacgctggcggcgtgcttaacacatgcaagtcgaacgatgaagaaaagaatcgaagcttcggcagaaattcatttcggattagtggcagacgggtgagtaacgcgtgagcaacctacctcttacaaagggatagcctcgggaaaccgggattaataccatataacattgcgacgaagcatttcgatgcaatcaaagctacggcggtaagagatgggctcgcgtcccattaaccagatggtgaggtaacggctcaccatagtaacgatgggtaaccggcctgagagggtgaacggtcacactggaactgagacacggtccagactcctacgggaggcagcagtggggaatattgcacaatggagggaactctgatgcagcgacgccgcgtgagtgatgaaggaattcgtttcgtaaaactctgttctatgggaagaaaaggactgtaccataggagaaagctccggctaaatacgtgccagcagccgcggtaatacgtatggagcgagcgttgtccggaattattgggcgtaaagggtgcgcaggcggctttacaagttggatgtgaaatattgtggctcaaccacaaacgtgcatccaaaactgcaaagcttgagttaaggagaggtaagtggaattcctggtgtagcggtggaatgcgtagatatcaggaggaataccggtggcgaaggcgacttactggacttaaactgacgctcaggcacgaaagcgtggggagcaaacaggattagataccctggtagtccacgccgtaaacgatgagtgctaggtgttgggggtcaaacctcggtgccgcaagcaaacgcaataagcactccgcctggggagtacgtgcacaagcatgaaactcaaaggaattgacggggacccgcacaagcagcggagcatgtggtttaattcgtggctacgcgaagaaccttaccagggcttgacatatatatgaggggacatagagatatgaaaccagtaagagcttgctcttaacatatatacaggtggtgcatggttgtcgtcagctcgtgtcgtgagatgttgggttaagtcccgcaacgagcgcaacccttgcaattagttactaacagatcatgctgaggactctaattggactgccgatgataaatcggaggaaggtggggatgacgtcaaatcatcatgccctttatgtcctgggctacacacgtgctacaatggtcggaacaaagaggagcgaaatggtgacatcaagcaaatctcaaaaaaccgatcccagttcggattgtactctgcaactcgagtacatgaagtcggagttgctagtaatcgcggatcagaatgccgcggtgaatgcgttcccgggtcttgtacacaccgcccgtcacaccatggaagttggcaatacccgaagccgatggcctaaccgcaaggaaggagtcgtcgaaggtagggtcaatgactggggtgaagtcgtaacaaggtagccgtatcggaaggtgcggctggatcacctcctttctaagga

SEQ ID NO: 10135 - DNA, 1542 bp, Bacteroides pectinophilus
  ref <308>: DATABASE ACCESSION NUMBER: NCBI ACCESSION: NZ_DS996921.1
  ref <309>: DATABASE ENTRY DATE: 2019-04-01
  ref <313>: RELEVANT RESIDUES IN SEQ ID NO: (1)..(1542)
tttttatgagagtttgatcctggctcaggatgaacgctggcggcgtgcttaacacatgcaagtcgaacgaagcacttaatgagatttcttcggattgattattttgtgactgagtggcggacgggtgagtaacgcgtgggtaacctgccccagaccgggggataacagtcggaaacgactgctaataccgcataagcgcacagtgccgcatggcacggtgtgaaaaactccggtggtctgggatggacccgcgtccgattagttagttggcggggtaacggcccaccaagaccgcgatcggtagccgacctgagagggtgaccggccacattgggactgagacacggcccagactcctacgggaggcagcagtggggaatattgcacaatggaggaaactctgatgcagcgacgccgcgtgagcgaagaagtatttcggtatgtaaagctctgtcagcagggaagataatgacggtacctgaccaagaagccccggctaactacgtgccagcagccgcggtaatacgtagggggcaagcgttatccggatttactgggtgtaaagggagtgtaggtggctgtgcaagtcaggagtgaaagcccggggctcaaccccgggactgctcttgaaactgcgcagcttgagtgcaggaggggcaggcggaattcctagtgtagcggtgaaatgcgtagatattaggaggaacaccggtggcgaaggcggcctgctggactgtaactgacactgaggctcgaaagcgtggggagcaaacaggattagataccctggtagtccacgccgtaaacgatgaatactaggtgtcggggctcataagagcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaggtcttgacatcctcctgaacggaaggtaatgcttccggtccttcgggacaggagagacaggtggtgcatggttgtcgtcagctcgtgtcgtgagatgttgggttaagtcccgcaacgagcgcaacccctatcctcagtagccagcagtccggctgggcactctgtggagactgccggggataacccggaggaaggtggggatgacgtcaaatcatcatgccccttatgacctgggctacacacgtgctacaatggcgctcaacaaagggaagcaatgccgcgaggccgagcaaatcccaaaaacagcgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagtcagtgacccaaccgcaaggagggagctgccgaaggcaggtctggtaactggggtgaagtcgtaacaaggtagccgtatcggaaggtgcggctggatcacctcctttctaaggaa

SEQ ID NO: 10136 - DNA, 1551 bp, Brevibacterium frigoritolerans; identical to SEQ ID NO: 10127
  ref <308>: DATABASE ACCESSION NUMBER: NCBI ACCESSION: NZ_CP030063.1
  ref <309>: DATABASE ENTRY DATE: 2019-04-01
  ref <313>: RELEVANT RESIDUES IN SEQ ID NO: (1)..(1551)

SEQ ID NO: 10137 - DNA, 1454 bp, Butyribacterium methylotrophicum
  ref <308>: DATABASE ACCESSION NUMBER: NCBI ACCESSION: NZ_MIMZ01000019.1
  ref <309>: DATABASE ENTRY DATE: 2019-04-01
  ref <313>: RELEVANT RESIDUES IN SEQ ID NO: (1)..(1454)
gttttgaatgatccttcgggtgaaattagaactggaaagtggcgaacgggtgagtaacgcgtgggtaacctgccctatggaaaggaatagcctcgggaaactgggagtaaagccttatattatggttttgtcgcatggcgagatcatgaaaactccggtgccataggatggacccgcgtcccattagctagttggtgagataacagcccaccaaggcgacgatgggtaaccggtctgagagggcgaacggtcacactggaactgagacacggtccagactcctacgggaggcagcagtggggaatattgcgcaatgggggcaaccctgacgcagcaataccgcgtgagtgaagaaggttttcggatcgtaaagctctgttattggggaagaaaacatgacggtacccaatgaggaagtcccggctaactacgtgccagcagccgcggtaatacgtaggggacaagcgttgtccggaatgactgggcgtaaagggcgcgtaggcggtctattaagtctgatgtgaaaggtaccggctcaaccggtgaagtgcattggaaactggtagacttgagtattggagaggcaagtggaattcctagtgtagcggtgaaatgcgtagatattaggaggaacaccagtggcgaaggcggcttgctggacaaatactgacgctgaggtgcgaaagcgtggggagcgaacaggattagataccctggtagtccacgccgtaaacgatgaatgctaggtgttggggaaactcagtgccgcagttaacacaataagcattccgcctggggagtacgaccgcaaggttgaaactcaaaggaattgacggggacccgcacaagcagcggagcatgtggtttaattcgaagcaacgcgaagaaccttaccaggtcttgacatcctctgacgagcctagagataggaagtttccttcgggaacagagagacaggtggtgcatggttgtcgtcagctcgtgtcgtgagatgttgggttaagtcccgcaacgagcgcaacccctgcctttagttgccagcattaagttgggcactctagagggactgccgtagacaatacggaggaaggtggggatgacgtcaaatcatcatgccccttatgacctgggctacacacgtgctacaatggtctgaacagagggccgcgaagccgcgaggtgaagcaaatcccttaaaacagatcccagttcggattgcaggctgcaactcgcctgcatgaagttggagttgctagtaatcgcggatcagaatgccgcggtgaatgcgttcccgggtcttgtacacaccgcccgtcacaccacgagagttggcaacacccgaagcctgtgagagaaccgcaaggactcagcagtcgaaggtggggctagtaattggggtgaagtcgtaacaaggtagccgtatcggaaggtgcggctggatcacctcctttcta

SEQ ID NO: 10138 - DNA, 1540 bp, Clostridium algidixylanolyticum
  ref <308>: DATABASE ACCESSION NUMBER: NCBI ACCESSION: NZ_MCIA01000027.1
  ref <309>: DATABASE ENTRY DATE: 2019-04-01
  ref <313>: RELEVANT RESIDUES IN SEQ ID NO: (1)..(1540)
ttaatttgagagttcgatcctggctcaggatgaacgctggcggcgtgcttaacacatgcaagtcgagcgaagcgattttaaggaagccttcgggtggaattaaaattgacttagcggcggacgggtgagtaacgcgtgggtaacctgcctcatacagggggataacagttagaaatgactgctaataccgcataagcgcacagtgctgcatagcacagtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgactgaagaagtatttcggtatgtaaaggtctatcagcagggaagaaaatgacggtacctgactaagaagccccggctaactacgtgccagcagccgcggtaatacgtagggggcaagcgttatccggatttactgggtgtaaagggagcgtagacggctctgcaagtctggagtgaaagcccggggctcaaccccgggactgctttggaaactgtggagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgtcggggagcaaagctcttcggtgccgtcgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgacagccttataactaaggtctccctacggggcattctagacaggtggtgcatggttgtcgtcagctcgtgtcgtgagatgttgggttaagtcccgcaacgagcgcaacccttatccttagtagccagcagttcggctgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcagatcagaatgctgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacctcctttctaaggaa

SEQ ID NO: 10139 - DNA, 1539 bp, Clostridium asparagiforme
  ref <308>: DATABASE ACCESSION NUMBER: NCBI ACCESSION: NZ_QSBM01000045.1
  ref <309>: DATABASE ENTRY DATE: 2019-04-01
  ref <313>: RELEVANT RESIDUES IN SEQ ID NO: (1)..(1539)
ttaatttgagagtttgatcctggctcaggatgaacgctggcggcgtgcctaacacatgcaagtcgaacgaagcattttagatgaagttttcggatggattctgagatgactgagtggcggacgggtgagtaacacgtggataacctgcctcacactgggggacaacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagataatgacggtacctgactaagaagccccggctaactacgtgccagcagccgcggtaatacgtagggggcaagcgttatccggatttactgggtgtaaagggagcgtagacggcatggcaagtctgaagtgaaaacccagggctcaaccctgggactgctttggaaactgtcaagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgagtgctaggtgttggggggcaaagcccttcggtgccgtcgcaaacgcaataagcactccacctggggagtacgttcgcaagaatgaaactcaaaggaattgacggggacccgcacaagcggtggagcatgtggtttaattcgaagcaacgcgaagaaccttaccaagtcttgacatccccctgaccggcgtgtaacggcgcctttccttcgggacaggggagacaggtggtgcatggttgtcgtcagctcgtgtcgtgagatgttgggttaagtcccgcaacgagcgcaacccttatccttagtagccagcattaagatgggcactctagggagactgccagggacaacctggaggaaggtggggatgacgtcaaatcatcatgccccttatgatttgggctacacacgtgctacaatggcgtaaacaaagggaagcgaccctgcgaaggtgagcaaatctcaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaa

SEQ ID NO: 10140 - DNA, 1542 bp, Clostridium bolteae
  ref <308>: DATABASE ACCESSION NUMBER: NCBI ACCESSION: NZ_QSHZ01000091.1
  ref <309>: DATABASE ENTRY DATE: 2019-04-01
  ref <313>: RELEVANT RESIDUES IN SEQ ID NO: (1)..(1542)
ttaaacatgagagtttgatcctggctcaggatgaacgctggcggcgtgcctaacacatgcaagtcgaacgaagcaattgaaggaagttttcggatggaattcgattgactgagtggcggacgggtgagtaacgcgtggataacctgcctcacactgggggataacagttagaaatgactgctaataccgcataagcgcacagtaccgcatggtacggtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgtcgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatcctcttgaccggcgtgtaacggcgccttcccttcggggcaagagagacaggtggtgcatggttgtcgtcagctcgtgtcgtgagatgttgggttaagtcccgcaacgagcgcaacccttatccttagtagccagcaggtaaagctgggcactctagggagactgccagggataacctggaggaaggtggggatgacgtcaaatcatcatgccccttatgatttgggctacacacgtgctacaatggcgtaaacaaagggaagcaagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaactcgcaagagagggagctgccgaaggcggggcaggtaactggggtgaagtcgtaacaaggtagccgtatcggaaggtgcggctggatcacctcctttctaaggaa

SEQ ID NO: 10141 - DNA, 1542 bp, Clostridium celerecrescens
  ref <308>: DATABASE ACCESSION NUMBER: NCBI ACCESSION: NZ_PGET01000001.1
  ref <309>: DATABASE ENTRY DATE: 2019-04-01
  ref <313>: RELEVANT RESIDUES IN SEQ ID NO: (1)..(1542)
tttaatttgagagttcgatcctggctcaggatgaacgctggcggcgtgcttaacacatgcaagtcgagcgaagcgatttcaaggaagttttcggacggaattgaaattgactgagcggcggacgggtgagtaacgcgtgggtaacctgcctcatacagggggataacagttggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcactgcaagtctggagtgaaagcccggggctcaaccccgggactgctttggaaactgtggtgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccgggatgtaacgatcccttcccttcggggcattccagacaggtggtgcatggttgtcgtcagctcgtgtcgtgagatgttgggttaagtcccgcaacgagcgcaacccttatccttagtagccagcaggtaaagctgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacctcctttctaaggaa

SEQ ID NO: 10142 - DNA, 1520 bp, Clostridium cellulosi
  ref <308>: DATABASE ACCESSION NUMBER: NCBI ACCESSION: NZ_LM995447.1
  ref <309>: DATABASE ENTRY DATE: 2019-04-01
  ref <313>: RELEVANT RESIDUES IN SEQ ID NO: (1)..(1520)
cgatatattagagagtttgatcctggctcaggacgaacgctggcggcgcgcctaacacatgcaagtcgagcggagatagtacttcggttctatcttagcggcggacgggtgagtaacgcgtgagcaacctgcccttgagcgggggatagcgtctggaaacggacggtaataccgcataatgtacgttggaggcatctccgatgtaccaaaggagaaatccactcaaggatgggctcgcgtccgattaggtagttggtgaggtaatggcccaccaagcctgcgatcggtagccggactgagaggttgtacggccacattgggactgagacacggcccagactcctacgggaggcagcagtgggggatattgcacaatggaggaaactctgatgcagcgacgccgcgtgagggaagaaggtcttcggattgtaaacctctgtctttcgggacgaaggaagtgacggtaccgaaagaggaagccacggctaactacgtgccagcagccgcggtaatacgtaggtggcgagcgttgtccggaattactgggtgtaaagggtgcgtaggcgggttgtcaagttggatgtgaaatctctgggcttaactcagaggttgcattcaaaactggcgatcttgagtgaggtagaggcaggcggaattcccggtgtagcggtgaaatgcgtagatatcgggaggaacaccagtggcgaaggcggcctgctgggccttaactgacgctgaggcacgaaagcatggggagcaaacaggattagataccctggtagtccatgctgtaaacgatgattgctaggtgtgggtggactgaccccatccgtgccggagttaacacaataagcaatccacctggggagtacggccgcaaggttgaaactcaaaggaattgacgggggcccgcacaagcagtggagtatgtggtttaattcgaagcaacgcgaagaaccttaccaggtcttgacatccaccgaatccggaagagattctggagtgcccttcggggagcggtgagacaggtggtgcatggttgtcgtcagctcgtgtcgtgagatgttgggttaagtcccgcaacgagcgcaacccttgttaatagttgctacgcaagagcactctattaagactgccgttgataaaacggaggaaggtggggatgacgtcaaatcatcatgccccttatgacctgggctacacacgtactacaatggccgccaacaaagggaagcaataccgcgaggtggagcgaatccccaaaagcggtcccagttcagattgcaggctgcaacccgcctgcatgaagacggaattgctagtaatcgcggatcagcatgccgcggtgaatacgttcccgggccttgtacacaccgcccgtcacaccatgagagccggaaacacccgaagtcgtttgcgtaaccgaaaggagcgcggcgccgaaggtgggatcggtgattggggtgaagtcgtaacaaggtagccgtatcggaaggtgcggctggatcacctcctttcta

SEQ ID NO: 10143 - DNA, 1540 bp, Clostridium clostridioforme
  ref <308>: DATABASE ACCESSION NUMBER: NCBI ACCESSION: NZ_UAVW01000018.1
  ref <309>: DATABASE ENTRY DATE: 2019-04-01
  ref <313>: RELEVANT RESIDUES IN SEQ ID NO: (1)..(1540)
gaacatgagagtttgatcctggctcaggatgaacgctggcggcgtgcctaacacatgcaagtcgaacgaagcaattaagatgaagttttcggatggaatcttgattgactgagtggcggacgggtgagtaacgcgtggataacctgcctcacactgggggataacagttagaaatgactgctaataccgcataagcgcacagtgccgcatggcagtgtgtgaaaaactccggtggtgtgagatggatccgcgtctgattagccagttggcggggtaacggcccaccaaagcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcgaagcaagtctgaagtgaaaacccagggctcaaccctgggactgctttggaaactgttttgctagagtgtcggagaggtaagtggaattcctagtgtagcggtgaaatgcgtagatattaggaggaacaccagtggcgaaggcggcttactggacgataactgacgttgaggctcgaaagcgtggggagcaaacaggattagataccctggtagtccacgccgtaaacgatgaatgctaggtgttggggggcaaagcccttcggtgccgccgcaaacgcagtaagcattccacctggggagtacgttcgcaagaatgaaactcaaaggaattgacggggacccgcacaagcggtggagcatgtggtttaattcgaagcaacgcgaagaaccttaccaagtcttgacatccccctgacgggccggtaacgcggcctttccttcgggacaggggagacaggtggtgcatggttgtcgtcagctcgtgtcgtgagatgttgggttaagtcccgcaacgagcgcaacccttatccttagtagccagcacgtgaaggtgggcactctagggagactgccagggataacctggaggaaggtggggatgacgtcaaatcatcatgccccttatgatttgggctacacacgtgctacaatggcgtaaacaaagggaagcgagacagtgatgtggagcaaatcccaaaaataacgtcccagttcggactgtagtctgcaacccgactacacgaagctggaatcgctagtaatcgcgaatcagaatgtcgcggtgaatacgttcccgggtcttgtacacaccgcccgtcacaccatgggagtcagcaacgcccgaagtcagtgacccaaccgaaaggagggagctgccgaaggcggggcaggtaactggggtgaagtcgtaacaaggtagccgtatcggaaggtgcggctggatcacctcctttctaaggaa

SEQ ID NO: 10144 - DNA, 1555 bp, Clostridium indolis; identical to SEQ ID NO: 8804
  ref <308>: DATABASE ACCESSION NUMBER: NCBI ACCESSION: NZ_UYIM01000001.1
  ref <309>: DATABASE ENTRY DATE: 2019-04-01
  ref <313>: RELEVANT RESIDUES IN SEQ ID NO: (1)..(1555)

SEQ ID NO: 10145 - DNA, 1559 bp, Clostridium leptum
  ref <308>: DATABASE ACCESSION NUMBER: NCBI ACCESSION: NZ_QRXM01000026.1
  ref <309>: DATABASE ENTRY DATE: 2019-04-01
  ref <313>: RELEVANT RESIDUES IN SEQ ID NO: (1)..(1559)
aaattttagagagtttgatcctggctcaggacgaacgctggcggcgtgcctaacacatgcaagtcgaacggagttaaattcgacacccgagtatccggccgggaggcggggtgctgggggttggatttaacttagtggcggacgggtgagtaacgcgtgagtaacctgcctttcagagggggataacgttctgaaaagaacgctaataccgcataacatcaatttatcgcatgataggttgatcaaaggagcaatccgctggaagatggactcgcgtccgattagccagttggcggggtaacggcccaccaaagcgacgatcggtagccggactgagaggttgaacggccacattgggactgagacacggcccagactcctacgggaggcagcagtgggggatattgcacaatgggggaaaccctgatgcagcaacgccgcgtgagggaagaaggttttcggattgtaaacctctgttcttagtgacgataatgacggtagctaaggagaaagctccggctaactacgtgccagcagccgcggtaatacgtagggagcgagcgttgtccggatttactgggtgtaaagggtgcgtaggcggcgaggcaagtcaggcgtgaaatctatgggcttaacccataaactgcgcttgaaactgtcttgcttgagtgaagtagaggtaggcggaattcccggtgtagcggtgaaatgcgtagagatcgggaggaacaccagtggcgaaggcggcctactgggctttaactgacgctgaagcacgaaagcatgggtagcaaacaggattagataccctggtagtccatgccgtaaacgatgattactaggtgtggggggtctgaccccctccgtgccgcagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccgtctaacgaagcagagatgcattaggtgcccttcggggaaaggcgagacaggtggtgcatggttgtcgtcagctcgtgtcgtgagatgttgggttaagtcccgcaacgagcgcaacccttgtttctagttgctacgcaagagcactctagagagactgccgttgacaaaacggaggaaggtggggacgacgtcaaatcatcatgccccttatgacctgggccacacacgtactacaatggctgtaaacagagggaagcaaagccgcgaggtggagcaaaaccctaaaagcagtcccagttcggatcgcaggctgcaacccgcctgcgtgaagtcggaattgctagtaatcgcggatcagcatgccgcggtgaatacgttcccgggccttgtacacaccgcccgtcacaccatgggagccggtaatacccgaagccagtagttcaaccgcaaggagagcgctgtcgaaggtaggattggcgactggggtgaagtcgtaacaaggtagccgtatcggaaggtgcggctggatcacctcctttctatgga

SEQ ID NO: 10146 - DNA, 1542 bp, Clostridium methoxybenzovorans
  ref <308>: DATABASE ACCESSION NUMBER: NCBI ACCESSION: NZ_ATXD01000006.1
  ref <309>: DATABASE ENTRY DATE: 2019-04-01
  ref <313>: RELEVANT RESIDUES IN SEQ ID NO: (1)..(1542)
ttaaatttgagagttcgatcctggctcaggatgaacgctggcggcgtgcttaacacatgcaagtcgagcgaagcgatttaaatgaagttttcggatggaatttaaattgactgagcggcggacgggtgagtaacgcgtgggtaacctgcctcatacagggggataacagttggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtgtttcggcatgtaaagctctatcagcagggaagaaaatgacggtacctgactaagaagccccggctaactacgtgccagcagccgcggtaatacgtagggggcaagcgttatccggatttactgggtgtaaagggagcgtagacggcgatgcaagtctggagtgaaagcccggggctcaaccccgggactgctttggaaactgtgttgctggagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccggtccgtaacggggccttcccttcggggcattccagacaggtggtgcatggttgtcgtcagctcgtgtcgtgagatgttgggttaagtcccgcaacgagcgcaacccttatccttagtagccagcaagtcaagttgggcactctggggagactgccagggataacctggaggaaggtggggatgacgtcaaatcatcatgccccttatgatttgggctacacacgtgctacaatggcgtaaacaaagggaagcaaaggagtgatccggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgcaaggagggagctgccgaaggcgggactgataactggggtgaagtcgtaacaaggtagccgtatcggaaggtgcggctggatcacctcctttctaaggaa

SEQ ID NO: 10147 - DNA, 1536 bp, Clostridium methylpentosum
  ref <308>: DATABASE ACCESSION NUMBER: NCBI ACCESSION: NZ_EQ973341.1
  ref <309>: DATABASE ENTRY DATE: 2019-04-01
  ref <313>: RELEVANT RESIDUES IN SEQ ID NO: (1)..(1536)
tttaattaagagtttgatcctggctcaggacgaacgctggcggcgcgcctaacacatgcaagtcgaacggagttgttttggagaagcccttcggggtggaactgattcaacttagtggcggacgggtgagtaacacgtgagcaacctgccttacagaggggaataacgtttggaaacgaacgctaataccgcataacataacggaatcgcatggttttgttatcaaagattatatcgctgtaagatgggctcgcgtctgattagatagttggtgaggtaatggctcaccaagtcgacgatcagtagccggactgagaggttgaacggccacattgggactgagacacggcccagactcctacgggaggcagcagtggggaatattgcacaatgggggaaaccctgatgcagcgacgccgcgtgaaggaagaaggccttcgggttgtaaacttctgtcttcagggacgataatgacggtacctgaggaggaagctccggctaactacgtgccagcagccgcggtaatacgtagggagcgagcgttgtccggaattactgggtgtaaagggagcgtaggcgggattgcaagttgaatgtgaaatctatgggcttaacccataaactgcgttcaaaactgcagttcttgagtgaagtagaggcaggcggaattcctagtgtagcggtgaaatgcgtagatattaggaggaacaccagtggcgaaggcggcctgctgggctttaactgacgctgaggctcgaaagcgtgggtagcaaacaggattagataccctggtagtccacgccgtaaacgatgattactaggtgtaggggggtcaaccttctgtgccggagttaacacaataagtaatccacctggggagtacgaccgcaaggttgaaactcaaaggaattgacgggggcccgcacaagcagtggagtatgtggtttaattcgaagcaacgcgaagaaccttaccaggtcttgacatccaactaacgaagtagagatacattaggtgcccttcggggaaagttgagacaggtggtgcatggttgtcgtcagctcgtgtcgtgagatgttgggttaagtcccgcaacgagcgcaacccttacatttagttgctacgcaagagcactctagatggactgccgttgacaaaacggaggaaggtggggatgacgtcaaatcatcatgccccttatgacctgggctacacacgtactacaatggctattaacagagggaagcaaaacagtgatgtggagcaaacccctaaaaatagtctcagttcggattgtaggctgcaactcgcctacatgaagccggaattgctagtaatcgcggatcagcatgccgcggtgaatacgttcccgggccttgtacacaccgcccgtcacaccatgagagttggcaacacccgaagtcagtagtctaaccgcaaggaggacgctgccgaaggtggggttgatgattagggtgaagtcgtaacaaggtagccgtatcggaaggtgcggctggatcacctcctttctatgga

SEQ ID NO: 10148 - DNA, 1634 bp, Clostridium paradoxum
  ref <308>: DATABASE ACCESSION NUMBER: NCBI ACCESSION: NZ_LSFY01000001.1
  ref <309>: DATABASE ENTRY DATE: 2019-04-01
  ref <313>: RELEVANT RESIDUES IN SEQ ID NO: (1)..(1634)
ttatatttgagagtttgatcctggctcaggatgaacgctggcggcgtgcctaacacatgcaagtcgagcggagatagtgtttaacactgagtatttatttaaagtgctaatttgatagcctttgatagccgcgtcaagcgcgcgatagcgagcttgacgcaaattatgtttaacacacaataagtattgagtgttaaacactatctcagcggcggacgggtgagtaacgcgtgggtaacctgccctgtacacttggataacacaccgaaaggtgtgctaatacaagatgatatcaaaggaaggcatcttcttttgatcaaagtttttgcggtacaggatgggcccgcgtcccattagctagttggtggggtaacggcctaccaaggcgacgatgggtagccgacctgagagggtgatcggccacactggaactgagacacggtccagactcctacgggaggcagcagtggggaatattgcacaatgggcgaaagcctgatgcagcaacgccgcgtgaacgatgaaggccttcgggtcgtaaagttctgtccttgaggaagaattctgacggtactcaaggaggaagccccggctaactacgtgccagcagccgcggtaatacgtagggggctagcgttatccggaattactgggcgtaaagggtgcgtaggcggcccttcgagtcagaggtgaaaggctacggctcaaccgtagtaagcctttgaaactgttgggcttgagtgcaggagaggagagtggaattcccagtgtagcggtgaaatgcgtagatattgggaggaacaccagttgcgaaggcggctctctggactgcaactgacgctgaggcacgaaagcgtggggagcaaacaggattagataccctggtagtccacgccgtaaacgatgagtgctaggtgtcgggagttacccctctcggtgccgtagttaacgcattaagcactccgcctggggagtacgctcgcaagagtgaaactcaaaggaattgacggggacccgcacaagcagcggagcatgtggtttaattcgaagcaacgcgaagaaccttacctaggcttgacatcccttagacagctccttaatcggagccttcctttcggggactgaggtgacaggtggtgcatggttgtcgtcagctcgtgtcgtgagatgttgggttaagtcccgcaacgagcgcaacccttacttttagttgccagcattaagttgggcactctaaagggactgccgaggataactcggaggaaggtggggatgacgtcaaatcatcatgccccttatgcctagggctacacacgtgctacaatggccagtacagagggctgcaaggtcgtgaggctgagctaatcccttaaagctggtctcagttcggattgcaggctgaaactcgcctgcatgaagctggagttgctagtaatcgcggatcagaatgccgcggtgaatacgttcccgggtcttgtacacaccgcccgtcacaccatgggagtcgggggcacccgaagtcagctacctaaccgcaaggagggggctgccgaaggtgaaatcgatgactggggtgaagtcgtaacaaggtagccgtatcggaaggtgcggctggatcacctcctttctaagga

SEQ ID NO: 10149 - DNA, 1542 bp, Clostridium sphenoides
  ref <308>: DATABASE ACCESSION NUMBER: NCBI ACCESSION: NZ_UFXF01000001.1
  ref <309>: DATABASE ENTRY DATE: 2019-04-01
  ref <313>: RELEVANT RESIDUES IN SEQ ID NO: (1)..(1542)
tttaatttgagagttcgatcctggctcaggatgaacgctggcggcgtgcttaacacatgcaagtcgagcgaagcgattcaaatgaagttttcggacggattttgaattgacttagcggcggacgggtgagtaacgcgtgggtaacctgcctcatacagggggataacagtcggaaacgactgctaataccgcataagcacacagtgccgcatggtacggtgtgaaaaactccggtggtatgagatggacccgcgtctgattaggtagttggtgaggtaacggcccaccaagccgacgatcagtagccgacctgagagggtgaccggccacattgggactgagacacggcccaaactcctacgggaggcagcagtggggaatattggacaatgggggaaaccctgatccagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggcactgcaagtctggagtgaaagcccggggctcaaccccgggactgctttggaaactgtggtgctagagtgcaggagaggtaagtggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgaatactaggtgttggggagcaaagctcttcggtgccgccgctaacgcaataagtattccacctggggagtacgttcgcaagaatgaaactcaaaggaattgacggggacccgcacaagcggtggagcatgtggtttaattcgaagcaacgcgaagaaccttaccaagtcttgacatcggaatgaccgggatgtaacgatcccttcccttcggggcattccagacaggtggtgcatggttgtcgtcagctcgtgtcgtgagatgttgggttaagtcccgcaacgagcgcaacccttatccttagtagccagcaggtagagctgggcactctggggagactgccagggataacctggaggaaggtggggatgacgtcaaatcatcatgccccttatgatttgggctacacacgtgctacaatggcgtaaacaaagggaagcaaaggagcgatctggagcaaaccccaaaaataacgtctcagttcggattgtagtctgcaactcgactacatgaagctggaatcgctagtaatcgcggatcagaatgccgcggtgaatacgttcccgggtcttgtacacaccgcccgtcacaccatgggagttggtaacgcccgaagtcagtgacccaaccgtaaggagggagctgccgaaggcgggactgataactggggtgaagtcgtaacaaggtagccgtatcggaaggtgcggctggatcacctcctttctaaggaa

SEQ ID NO: 10150 - DNA, 1526 bp, Clostridium spiroforme
  ref <308>: DATABASE ACCESSION NUMBER: NCBI ACCESSION: NZ_QSVF01000007.1
  ref <309>: DATABASE ENTRY DATE: 2019-04-01
  ref <313>: RELEVANT RESIDUES IN SEQ ID NO: (1)..(1526)
aatggagagtttgatcctggctcaggatgaacgctggcggcgtgcctaatacatgcaagtcgaacgcgagcagcaatgctcgagtggcgaacgggtgagtaatacataagtaacctgccctagacagggggataactgctggaaacggcagctaagaccgcataggtatggacactgcatggtgaccatattaaaagtgccaaggcactggtagaggatggacttatggcgcattagctggttggtgaggtaacggctcaccaaggcgacgatgcgtagccgacctgagagggtgaccggccacactgggactgagacacggcccagactcctacgggaggcagcagtagggaattttcggcaatggggggaaccctgaccgagcaacgccgcgtgaaggaagaaggaattcgttctgtaaacttctgttataaaggaagaacggcggatatagggaatgatatccgagtgacggtactttatgagaaagccacggctaactacgtgccagcagccgcggtaatacgtaggtggcgagcgttatccggaattattgggcgtaaagagggagcaggcggcggcagaggtctgtggtgaaagactgaagcttaacttcagtaagccatagaaaccgggctgctagagtgcaggagaggatcgtggaattccatgtgtagcggtgaaatgcgtagatatatggaggaacaccagtggcgaaggcgacggtctggcctgtaactgacgctcattcccgaaagcgtggggagcaaataggattagataccctagtagtccacgccgtaaacgatgagtactaagtgttgggagtcaaatttcagtgctgcagttaacgcaataagtactccgcctgagtagtacgttcgcaagaatgaaactcaaaggaattgacgggggcccgcacaagcggtggagcatgtggtttaattcgaagcaacgcgaagaaccttaccaggtcttgacatccggataaagacctcagagatgaggggatagatatatccgagacaggtggtgcatggttgtcgtcagctcgtgtcgtgagatgttgggttaagtcccgcaacgagcgcaacccttgtcgctagttaccatcattaagttggggactctagcgagactgccagtgacaagctggaggaaggcggggatgacgtcaaatcatcatgccccttatgacctgggctacacacgtgctacaatggatggagcagagggaagcgaagccgcgaggtgaagcaaaacccataaaaccattctcagttcggattgtagtctgcaactcgactacatgaagttggaatcgctagtaatcgcgaatcagcatgtcgcggtgaatacgttctcgggccttgtacacaccgcccgtcacaccatgagagttgataacacccgaagccggtggcctaaccgcaaggagggagctgtctaaggtgggattgatgattggggtgaagtcgtaacaaggtatccctacgggaacgtggggatggatcacctcctttcta

SEQ ID NO: 10151 - DNA, 1036 bp, Clostridium sporosphaeroides
  ref <308>: DATABASE ACCESSION NUMBER: NCBI ACCESSION: NZ_KB911086.1
  ref <309>: DATABASE ENTRY DATE: 2019-04-01
  ref <313>: RELEVANT RESIDUES IN SEQ ID NO: (1)..(1036)
cggtatcaaaggagcaatccgctgaaagatggactcgcgtccgattagccagttggcggggtaaaggcccaccaaagcgacgatcggtagccgggttgagagactgaacggccacattgggactgagacacggcccagactcctacgggaggcagcagtgggggatattgcacaatggaggaaactctgatgcagcaatgccgcgtgagggaagacggtcttcggattgtaaacctctgtccttggtgaagataatgacggtagccaaggaggaagctccggctaactacgtgccagcagccgcggtaatacgtagggagcaagcgttgtccggatttactgggtgtaaagggtgcgtaggcggctctttaagtcgggcgtgaaagctgtgggcttaacccacaaattgcgttcgaaactggagggcttgagtgaagtagaggtaggcggaattcccggtgtagcggtgaaatgcgtagagatcgggaggaacaccagtggcgaaggcggcctactgggctttaactgacgctgaggcacgaaagcatgggtagcaaacaggattagataccctggtagtccatgccgtaaacgatgattactaggtgtggggggtctgaccccttccgtgccggagttaacacaataagtaatccacctggggagtacggccgcaaggttgaaactcaaaggaattgacgggggcccgcacaagcagtggagtatgtggtttaattcgaagcaacgcgaagaaccttaccaggtcttgacatccaactaacgaggcagagatgcattaggtgcccttcggggaaagttgagacaggtggtgcatggttgtcgtcagctcgtgtcgtgagatgttgggttaagtcccgcaacgagcgcaacccttgtgattagttgctacgcaagagcactctaatcagactgccgttgacaaaacggaggaaggtggggacgacgtcaaatcatcatgccccttatgacctgggctacacacgtactacaatggtcgccaacagagggaagccaa

SEQ ID NO: 10152 - DNA, 1541 bp, Clostridium symbiosum
  ref <308>: DATABASE ACCESSION NUMBER: NCBI ACCESSION: NZ_UFXK01000003.1
  ref <309>: DATABASE ENTRY DATE: 2019-04-01
  ref <313>: RELEVANT RESIDUES IN SEQ ID NO: (1)..(1541)
ttaaacatgagagtttgatcctggctcaggatgaacgctggcggcgtgcctaacacatgcaagtcgaacgaagcgatttaacggaagttttcggatggaagttgaattgactgagtggcggacgggtgagtaacgcgtgggtaacctgccttgtactgggggacaacagttagaaatgactgctaataccgcataagcgcacagtattgcatgatacagtgtgaaaaactccggtggtacaagatggacccgcgtctgattagctagttggtaaggtaacggcttaccaaggcgacgatcagtagccgacctgagagggtgaccggccacattgggactgagacacggcccaaactcctacgggaggcagcagtggggaatattgcacaatgggcgaaagcctgatgcagcgacgccgcgtgagtgaagaagtatttcggtatgtaaagctctatcagcagggaagaaaatgacggtacctgactaagaagccccggctaactacgtgccagcagccgcggtaatacgtagggggcaagcgttatccggatttactgggtgtaaagggagcgtagacggtaaagcaagtctgaagtgaaagcccgcggctcaactgcgggactgctttggaaactgtttaactggagtgtcggagaggtaagtggaattcctagtgtagcggtgaaatgcgtagatattaggaggaacaccagtggcgaaggcgacttactggacgataactgacgttgaggctcgaaagcgtggggagcaaacaggattagataccctggtagtccacgccgtaaacgatgaatactaggtgttggggagcaaagctcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatcgatctgacgggggagtaacgtccccttcccttcggggcggagaagacaggtggtgcatggttgtcgtcagctcgtgtcgtgagatgttgggttaagtcccgcaacgagcgcaacccttattctaagtagccagcggttcggccgggaactcttgggagactgccagggataacctggaggaaggtggggatgacgtcaaatcatcatgccccttatgatctgggctacacacgtgctacaatggcgtaaacaaagagaagcaagaccgcgaggtggagcaaatctcaaaaataacgtctcagttcggactgcaggctgcaactcgcctgcacgaagctggaatcgctagtaatcgcgaatcagaatgtcgcggtgaatacgttcccgggtcttgtacacaccgcccgtcacaccatgggagtcagtaacgcccgaagtcagtgacccaaccgcaaggagggagctgccgaaggcgggaccgataactggggtgaagtcgtaacaaggtagccgtatcggaaggtgcggctggatcacctcctttctaaggaa

SEQ ID NO: 10153 - DNA, 1342 bp, Clostridium thermoalcaliphilum
  ref <308>: DATABASE ACCESSION NUMBER: NCBI ACCESSION: NZ_MZGW01000024.1
  ref <309>: DATABASE ENTRY DATE: 2019-04-01
  ref <313>: RELEVANT RESIDUES IN SEQ ID NO: (1)..(1342)
atatcaaaggaaggcatcttcttttgatcaaagcttttgcggtacaggatggacccgcgtcccattagctagttggtggggtaatggcctaccaaggcgacgatgggtagccgacctgagagggtgatcggccacactggaactgagacacggtccagactcctacgggaggcagcagtggggaatattgcacaatgggcgaaagcctgatgcagcaacgccgcgtgaacgatgaaggccttcgggtcgtaaagttctgtccttgaggaagaaattttgacggtactcaaggaggaagccccggctaactacgtgccagcagccgcggtaatacgtagggggctagcgttatccggaattactgggcgtaaagggtgcgtaggcggcccttcaagtcagaggtgaaaggctacggctcaaccgtagtaagcctttgaaactgttgggcttgagtgcaggagaggagagtggaattcccagtgtagcggtgaaatgcgtagatattgggaggaacaccagttgcgaaggcggctctctggactgtaactgacgctgaggcacgaaagcgtggggagcaaacaggattagataccctggtagtccacgccgtaaacgatgagtgctaggtgtcgggagttacccctctcggtgccgcagttaacgcattaagcactccgcctggggagtacgctcgcaagagtgaaactcaaaggaattgacggggacccgcacaagcagcggagcatgtggtttaattcgaagcaacgcgaagaaccttacctaggcttgacatcccttggacagctccttaatcggagccttcccttcggggactaaggtgacaggtggtgcatggttgtcgtcagctcgtgtcgtgagatgttgggttaagtcccgcaacgagcgcaacccctacttttagttgccatcattaagttgggcactctagagggactgccgaggataactcggaggaaggtggggatgacgtcaaatcatcatgccccttatgcctagggctacacacgtgctacaatggccagtacagagggcagcgaaaccgtgaggtcaagccaatcccttaaagctggtctcagttcggattgtaggctgaaactcgcctacatgaagctggagttgctagtaatcgcggatcagaatgccgcggtgaatgcgttcccgggtcttgtacacaccgcccgtcacaccatgggagtcgggggcacccgaagtcagctacccaaccgcaaggagggggctgccgaaggtgaaatcgatgactggggtgaagtcgtaacaaggtagccgtatcggaaggtgcggctggatcacctcctttcta

SEQ ID NO: 10154 - DNA, 1527 bp, Clostridium ultunense
  ref <308>: DATABASE ACCESSION NUMBER: NCBI ACCESSION: NZ_LT669839.1
  ref <309>: DATABASE ENTRY DATE: 2019-04-01
  ref <313>: RELEVANT RESIDUES IN SEQ ID NO: (1)..(1527)
aaatgagagtttgatcctggctcaggacgaacgctggcggcgtgcctaacacatgcaagtcgagcgaagaatttatcatgaagccttcgggtggaatgataaacttcttagcggcggatgggtgagtaacgcgtgaggaacctgccttccacaaggggatagcctcgggaaaccgggattaataccctatgaaacttagcaatcgcatgatatttaagttaaagcgttagcggtggaagatggcctcgcgtcccattagctagttggtgagttaaaagctcaccaaggcaacgatgggtagccggcttgagagagtgaccggccacactggaactgagacacggtccagactcctacgggaggcagcagtggggaatattgcacaatggagggaactctgatgcagcgacgccgcgtgagcgatgaaggccttcgggtcgtaaagctctgtcctatgggacgataatgacggtaccataggaggaagccccggctaactacgtgccagcagccgcggtaatacgtagggggcgagcgttgtccggaattactgggcgtaaagggtacgcaggcggtcaaataagtcagatgtgaaaggcgtaggcttaacctatgtaagcatttgaaactgtttggcttgagttaaggagaggaaagtggaattcctggtgtagcggtgaaatgcgtagatatcaggaggaatatcagtggcgaaggcgactttctggacttaaactgacgctgaggtacgaaagcgtggggagcaaacaggattagataccctggtagtccacgccgtaaacgatgagtgctaggtgtcggagggtaaccttcggtgccgaagttaacacattaagcactccgcctggggagtacgttcgcaagaatgaaactcaaaggaattgacggggacccgcacaagcagcggagcatgtggtttaattcgatgcaacgcgaagaaccttaccagggcttgacatccctcgggccgtcttagagataagaccttctcttcggagactgagggacaggtggtgcatggttgtcgtcagctcgtgtcgtgagatgttgggttaagtcccgcaacgagcgcaacccttgcctttagttgccaacagttaggctgtgcactctagagggactgccgatgataaatcggaggaaggtggggatgacgtcaaatcatcatgccctttatgtcctgggctacacacgtgctacaatggtcggtacaacgggtagcgacttagtgataaggagccaatcccttaaaaccgatcccagttcggattgcaggctgcaactcgcctgcatgaagccggagttgctagtaatcgtggatcagaatgccacggtgaatgcgttcccgggtcttgtacacaccgcccgtcacaccatgggagttagcaatacccgaagccagtgagccaaccgtaagggagcaactgtcgaaggtagggttaatgactggggtgaagtcgtaacaaggtagccgtatcggaaggtgcggctggatcacctcctttc

SEQ ID NO: 10155 - DNA, 1548 bp, Curtobacterium plantarum
  ref <308>: DATABASE ACCESSION NUMBER: NCBI ACCESSION: NZ_RHDS01000023.1
  ref <309>: DATABASE ENTRY DATE: 2019-04-01
  ref <313>: RELEVANT RESIDUES IN SEQ ID NO: (1)..(1548)
aaattgaagagtttgatcatggctcagattgaacgctggcggcaggcctaacacatgcaagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgacggggttaataaccgcgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctgaa

SEQ ID NO: 10156 - DNA, 1550 bp, Enterobacter lignolyticus
  ref <308>: DATABASE ACCESSION NUMBER: NCBI ACCESSION: NZ_CP012871.1
  ref <309>: DATABASE ENTRY DATE: 2019-04-01
  ref <313>: RELEVANT RESIDUES IN SEQ ID NO: (1)..(1550)
aaattgaagagtttgatcatggctcagattgaacgctggcggcaggcctaacacatgcaagtcgagcggtagcacagagagcttgctctcgggtgacgagcggcggacgggtgagtaatgtctgggaaactgcctgatggagggggataactactggaaacggtagctaataccgcataacgtcgcaagaccaaagtgggggaccttcgggcctcatgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcattgtggttaataaccgcagtgattgacgttactcgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtctatttggaggttgttcccttgaggagtggcttccggagctaacgcgttaaatagaccgcctggggagtacggccgcaaggttaaaactcaaatgaattgacgggggcccgcacaagcggtggagcatgtggtttaattcgatgcaacgcgaagaaccttacctggtcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 10157 - DNA, 553 bp, Erwinia teleogrylli
  ref <308>: DATABASE ACCESSION NUMBER: NCBI ACCESSION: NZ_LLXO01000107.1
  ref <309>: DATABASE ENTRY DATE: 2019-04-01
  ref <313>: RELEVANT RESIDUES IN SEQ ID NO: (1)..(553)
aatgtctgggtatctgcctgatggagggggataaccactggaaacggtggctaataccgcataacgtcgcaagaccaaagtgggggaccttcgggcctcatgccatcagatgaacccagatgggattagccagttggtgaggtaacggctcaccaaagcgacgatccctagctggtctgagaggatgaccagccacactggaactgagacacggtccagactcctacgggaggcagcagtggggaatattgcacaatgggggaaaccctgatgcagccatgccgcgtgtatgaagaaggccttcgggttgtaaagtactttcagcggggaggaaggtgctggggttaataaccgcagcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggctcaacccgggaactgcatctgatactggcaggcttgagtctcgtagagggggg

SEQ ID NO: 10158 - DNA, 1540 bp, Eubacterium hallii
  ref <308>: DATABASE ACCESSION NUMBER: NCBI ACCESSION: NZ_LT907978.1
  ref <309>: DATABASE ENTRY DATE: 2019-04-01
  ref <313>: RELEVANT RESIDUES IN SEQ ID NO: (1)..(1540)
tttatttgagagtttgatcctggctcaggatgaacgctggcggcgtgcctaacacatgcaagtcgaacgaagcaccttttgagattcttcggatgattgattggtgactgagtggcggacgggtgagtaacgcgtgggtaacctgccctgtacagggggataacagttggaaacggctgctaataccgcataagcgcacgagaggacatcctcttgtgtgaaaaactccggtggtacaggatgggcccgcgtctgattagctggttggcagggtaacagcctaccaaggcgacgatcagtagccggtctgagaggatgaacggccacattggaactgagacacggtccaaactcctacgggaggcagcagtggggaatattgcacaatgggggaaaccctgatgcagcaacgccgcgtgagtgaagaagtatttcggtatgtaaagctctatcagcagggaagataatgacggtacctgactaagaagctccggctaaatacgtgccagcagccgcggtaatacgtatggagcaagcgttatccggatttactgggtgtaaagggtgcgtaggtggcagtgcaagtcagatgtgaaaggccggggctcaaccccggagctgcatttgaaactgcatagctagagtacaggagaggcaggcggaattcctagtgtagcggtgaaatgcgtagatattaggaggaacaccagtggcgaaggcggcctgctggactgttactgacactgaggcacgaaagcgtggggagcaaacaggattagataccctggtagtccacgccgtaaacgatgaatactaggtgtcggggccgtataggcttcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaggtcttgacatccttctgaccgcaccttaatcggtgctttccttcgggacagaagagacaggtggtgcatggttgtcgtcagctcgtgtcgtgagatgttgggttaagtcccgcaacgagcgcaacccctatcttcagtagccagcaggttaagctgggcactctggagagactgccagggataacctggaggaaggtggggacgacgtcaaatcatcatgccccttatgatctgggcgacacacgtgctacaatggcggtcacaaagtgaggcaaacctgcgagggggagcaaaccacaaaaaggccgtcccagttcggactgtagtctgcaacccgactacacgaagctggaatcgctagtaatcgcgaatcagaatgtcgcggtgaatacgttcccgggtcttgtacacaccgcccgtcacaccatgggagtcggaaatgcccgaagccagtgacccaacctttatggagggagctgtcgaaggtggagccggtaactggggtgaagtcgtaacaaggtagccgtatcggaaggtgcggctggatcacctcctttctaaggaa

SEQ ID NO: 10159 - DNA, 1248 bp, Eubacterium rectale
  ref <308>: DATABASE ACCESSION NUMBER: NCBI ACCESSION: NZ_QRPB01000008.1
  ref <309>: DATABASE ENTRY DATE: 2019-04-01
  ref <313>: RELEVANT RESIDUES IN SEQ ID NO: (1)..(1248)
tttaacatgagagtttgatcctggctcaggatgaacgctggcggcgtgcttaacacatgcaagtcgaacgaagcactttatttgatttccttcgggactgattattttgtgactgagtggcggacgggtgagtaacgcgtgggtaacctgccttgtacagggggataacagttggaaacggctgctaataccgcataagcgcacagcatcgcatgatgcagtgtgaaaaactccggtggtataagatggacccgcgttggattagctagttggtgaggtaacggcccaccaaggcgacgatccatagccgacctgagagggtgaccggccacattgggactgagacacggcccaaactcctacgggaggcagcagtggggaatattgcacaatgggcgaaagcctgatgcagcgacgccgcgtgagcgaagaagtatttcggtatgtaaagctctatcagcagggaagataatgacggtacctgactaagaagcaccggctaaatacgtgccagcagccgcggtaatacgtatggtgcaagcgttatccggatttactgggtgtaaagggagcgcaggcggtgcggcaagtctgatgtgaaagcccggggctcaaccccggtactgcattggaaactgtcgtactagagtgtcggaggggtaagcggaattcctagtgtagcggtgaaatgcgtagatattaggaggaacaccagtggcgaaggcggcttactggacgataactgacgctgaggctcgaaagcgtggggagcaaacaggattagataccctggtagtccacgccgtaaacgatgaatactaggtgttgggaagcattgcttctcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagtcttgacatccttctgaccggtacttaaccgtaccttctcttcggagcaggagtgacaggtggtgcatggttgtcgtcagctcgtgtcgtgagatgttgggttaagtcccgcaacgagcgcaacccttatctttagtagccagcggttaggccgggcactctagagagactgccagggataacctggaggaaggcgaggatgacgtcaaatcatcatgccccttatgacttgggctacacacgtgctacaatggcgtaaacaaaggg

SEQ ID NO: 10160 - DNA, 1518 bp, Eubacterium siraeum
  ref <308>: DATABASE ACCESSION NUMBER: NCBI ACCESSION: NZ_CZBY01000005.1
  ref <309>: DATABASE ENTRY DATE: 2019-04-01
  ref <313>: RELEVANT RESIDUES IN SEQ ID NO: (1)..(1518)
tttaacaaagagtttgatcctggctcaggacgaacgctggcggcgcgcctaacacatgcaagtcgaacggtgaagaggagcttgctcctcggatcagtggcggacgggtgagtaacacgtgagcaacctggctctaagagggggacaacagttggaaacgactgctaataccgcataacgtatcgggatggcatcttcctgataccaaagattttatcgcttagagatgggctcgcgtctgattagatagttggcggggtaacggcccaccaagtcgacgatcagtagccggactgagaggttgaacggccacattgggactgagacacggcccagactcctacgggaggcagcagtgggggatattggacaatgggggcaaccctgatccagcgacgccgcgtgagggaagaaggttttcggattgtaaacctctgttgacggagaaaaaaatgatggtatccgtttagaaagccacggctaactacgtgccagcagccgcggtaatacgtaggtggcaagcgttgtccggaattactgggtgtaaagggagtgtaggcgggatatcaagtcagaagtgaaaattacgggctcaactcgtaacctgcttttgaaactgacattcttgagtgaagtagaggcaagcggaattcctagtgtagcggtgaaatgcgtagatattaggaggaacaccagtggcgaaggcggcttgctgggcttttactgacgctgaggctcgaaagcgtggggagcaaacaggattagataccctggtagtccacgccgtaaacgatgattactaggtgtggggggattgaccccttccgtgccggagtaaacacaataagtaatccacctggggagtacgaccgcaaggttgaaactcaaaggaattgacgggggcccgcacaagcagtggagtatgtggtttaattcgacgcaacgcgaagaaccttaccaggtcttgacatcaagtgacagtctaagagattaggccttcccttcggggacacaaagacaggtggtgcatggttgtcgtcagctcgtgtcgtgagatgttgggttaagtcccgcaacgagcgcaacccttatcattagttgctacgcaagagcactctaatgagactgccgttgacaaaacggaggaaggtggggatgacgtcaaatcatcatgccctttatgacctgggctacacacgtactacaatggcgtttaacaaagagaagcaaagccgcgaggcagagcaaatctccaaaaaacgtctcagttcggattgtaggctgcaactcgcctacatgaagtcggaattgctagtaatcgtaggtcagcatactacggtgaatacgttcccgggccttgtacacaccgcccgtcaaaccatgagagttggcaacacccgaagtcggtagtctaaccgcaaggaggacgccgccgaaggtggggttgatgattagggttaagtcgtaacaaggtagccgtatcggaaggtgcggctggatcacctcctttctaaggaa

SEQ ID NO: 10161 - DNA, 1362 bp, Flexibacter sp. ATCC 35208
  ref <308>: DATABASE ACCESSION NUMBER: NCBI ACCESSION: NZ_MTKN01000142.1
  ref <309>: DATABASE ENTRY DATE: 2019-04-01
  ref <313>: RELEVANT RESIDUES IN SEQ ID NO: (1)..(1362)
ggtagcaatactgggtggcgaccggcaaacgggtgcggaacacgtacgcaaccttccttcaagagatggatagcccgaagaaattcggattaatacatcgtaaaatcacagagtggcatcacttaatgattaaagaatttcgcttgaagatgggcgtgcgcctgattaggtagttggtgaggtaacggctcaccaagccgacgatcagtaactggcgtgagagcgcgaccagtcacacgggcactgagacacgggcccgactcctacgggaggcagcagtaaggaatattggtcaatggacggaagtctgaaccagccatgccgcgtgaaggatgaaggccctctgggtcgtaaacttcttttatctgggacgaaatcacttttttctaagagtgttgacggtaccagaggaataagcaccggctaactccgtgccagcagccgcggtaatacggagggtgcaagcgttatccggattcactgggtttaaagggtgcgtaggcggatttgtaagtccgtggtgaaatctccaggcttaacctggaaactgccatggatactataaatcttgaatgttgtggaggttagcggaatatgtcatgtagcggtgaaatgcatagatatgacatagaacaccaattgcgaaggcagctggctacacaaatattgacgctgaggcacgaaagcgtggggatcaaacaggattagataccctggtagtccacgccctaaacgatgattactcgacatttgtgatacacaataagtgtctgagcgaaagcattaagtaatccacctgggaagtacgaccgcaaggttgaaactcaaaggaattgacgggggtccgcacaagcggtggagcatgtggtttaattcgatgatacgcgaggaaccttacctgggctagaatgcaggatgaccgtgggtgaaagctcactttatagcaatatacatcttgtaaggtgctgcatggctgtcgtcagctcgtgccgtgaggtgttgggttaagtcccgcaacgagcgcaacccctatctttagttgccaacaggtcaagctgggaactctaaagaaactgccgtcgtaagacgcgaggaaggaggggatgatgtcaagtcatcatggcctttatgcccagggctacacacgtgctacaatggtaggaacaaagggctgctacttagtaataagatgctaatctcaaaaatcctatctcagttcgaattgagggctgcaactcgccctcatgaagctggaatcgctagtaatcgtatatcagcaatgatacggtgaatacgttcccggaccttgtacacaccgcccgtcaagccatgaaagccggggggacctgaagtcggtaaccg

SEQ ID NO: 10162 - DNA, 1552 bp, Kluyvera intestini
  ref <308>: DATABASE ACCESSION NUMBER: NCBI ACCESSION: NZ_MKZW03000001.1
  ref <309>: DATABASE ENTRY DATE: 2019-04-01
  ref <313>: RELEVANT RESIDUES IN SEQ ID NO: (1)..(1552)
aaattgaagagtttgatcatggctcagattgaacgctggcggcaggcctaacacatgcaagtcgaacggtagcacagaggagcttgctcctcgggtgacgagtggcggacgggtgagtaatgtctgggaaactgcccgatggagggggataactactggaaacggtagctaataccgcataatgtcgcaagaccaaagagggggaccttcgggcctcttgccatcggatgtgcccagatgggattagctagttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcaatgcggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaatttggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaa

SEQ ID NO: 10163 - DNA, 1493 bp, Oscillatoria sp. PCC 6506; identical to SEQ ID NO: 4447
  ref <308>: DATABASE ACCESSION NUMBER: NCBI ACCESSION: NZ_CACA01000066.1
  ref <309>: DATABASE ENTRY DATE: 2019-04-01
  ref <313>: RELEVANT RESIDUES IN SEQ ID NO: (1)..(1493)

SEQ ID NO: 10164 - DNA, 1548 bp, Pasteurella aerogenes
  ref <308>: DATABASE ACCESSION NUMBER: NCBI ACCESSION: NZ_LR134362.1
  ref <309>: DATABASE ENTRY DATE: 2019-04-01
  ref <313>: RELEVANT RESIDUES IN SEQ ID NO: (1)..(1548)
ttgaattgaagagtttgatcatggctcagattgaacgctggcggcaggcttaacacatgcaagtcgaacggtaacagggagaaagcttgctttctttgctgacgagtggcggacgggtgagtaatgcttgggaatctggcttatggagggggataacgacgggaaactgtcgctaataccgcgtagtgtcgagagacgaaagaccgggaccgcaaggccggttaccataagatgagcccaagtgggattaggtagttggtggggtaaaggcctaccaagcctgcgatctctagctggtctgagaggatggccagccacactggaactgagacacggtccagactcctacgggaggcagcagtggggaatattgcgcaatgggggcaaccctgacgcagccatgccgcgtgaatgaagaaggccttcgggttgtaaagttctttcggtgatgaggaaggcggttagtttaataggctaatcgattgacgttaatcacagaagaagcaccggctaactccgtgccagcagccgcggtaatacggagggtgcgagcgttaatcggaataactgggcgtaaagggcacgcaggcggttgcttaagtgaggtgtgaaatccccgggcttaacctgggaattgcatttcagactgggcagctagagtattttagggaggggtagaattccacgtgtagcggtgaaatgcgtagagatgtggaggaataccgaaggcgaaggcagccccttggggaaatactgacgctcatgtgcgaaagcgtggggagcaaacaggattagataccctggtagtccacgctgtaaacgctgtcgatttggggattgggctttaagcttggtgcccgtagctaacgtgataaatcgaccgcctggggagtacggccgcaaggttaaaactcaaatgaattgacgggggcccgcacaagcggtggagcatgtggtttaattcgatgcaacgcgaagaaccttacctactcttgacatccagagaagagcgcagagatgtgcttgtgccttcgggagctctgagacaggtgctgcatggctgtcgtcagctcgtgttgtgaaatgttgggttaagtcccgcaacgagcgcaacccttatcctttgttgccagcacgttatggtgggaactcaaaggagactgccggtgataaaccggaggaaggtggggatgacgtcaagtcatcatggcccttacgagtagggctacacacgtgctacaatggtgcatacagagagcgacgagaccgcgaggtggagtgaatctcagaaagtgcatctaagtccggattggagtctgcaactcgactccatgaagtcggaatcgctagtaatcgcgaatcagaatgtcgcggtgaatacgttcccgggccttgtacacaccgcccgtcacaccatgggagtgggttgtaccagaagtagatagcttaaccgagaggggggcgtttaccacggtatgattcatgactggggtgaagtcgtaacaaggtaaccgtaggggaacctgcggttggatcacctccttacct

SEQ ID NO: 10165 - DNA, 1536 bp, Propionibacterium humerusii; identical to SEQ ID NO: 6882
  ref <308>: DATABASE ACCESSION NUMBER: NCBI ACCESSION: NZ_PCZR01000001.1
  ref <309>: DATABASE ENTRY DATE: 2019-04-01
  ref <313>: RELEVANT RESIDUES IN SEQ ID NO: (1)..(1536)

SEQ ID NO: 10166 - DNA, 1534 bp, Propionibacterium namnetense
  ref <308>: DATABASE ACCESSION NUMBER: NCBI ACCESSION: NZ_PCZS01000001.1
  ref <309>: DATABASE ENTRY DATE: 2019-04-01
  ref <313>: RELEVANT RESIDUES IN SEQ ID NO: (1)..(1534)
ttttcattggagagtttgatcctggctcaggacgaacgctggcggcgtgcttaacacatgcaagtcgaacggaaaggcccccttgtggggtactcgagtggcgaacgggtgagtaacacgtgagtaacctacccttgactttgggataacttcaggaaactggggctaataccggataggagctcctgctgcatggtgggggttggaaagtttcggcggttggggatggactcgcggcttatcagcttgttggtggggtagtggctcaccaaggctttgacgggtagccggcctgagagggtgaccggccacattgggactgagatacggcccagactcctacgggaggcagcagtggggaatattgcacaatgggcggaagcctgatgcagcaacgccgcgtgcgggatgacggccttcgggttgtaaaccgctttcgcctgtgacgaagcgtgagtgacggtaatgggtaaagaagcaccggctaactacgtgccagcagccgcggtgatacgtagggtgcgagcgttgtccggatttattgggcgtaaagggctcgtaggtggttgatcgcgtcggaagtgaaatcttggggcttaaccctgagcgtgctttcgatacgggttgacttgaggaaggtaggggagaatggaattcctggtggagcggtggaatgcgcagatatcaggaggaacaccagtggcgaaggcggttctctggacctttcctgacgctgaggagcgaaagcgtggggagcgaacaggcttagataccctggtagtccacgctgtaaacggtgggtactaggtgtggggtccattccacggattccgtgccgtagctaacgctttaagtaccccgcctggggagtacggccgcaaggctaaaactcaaaggaattgacggggccccgcacaagcggcggagcatgcggattaattcgatgcaacgcgaagaaccttacctgggtttgacatggatcaggagtgctcagagatgggtatgcctcttttggggttggttcacaggtggtgcatggctgtcgtcagctcgtgtcgtgagatgttgggttaagtcccgcaacgagcgcaaccctcgttcactgttgccagcacgttatggtggggactcagtggagaccgccggggtcaactcggaggaaggtggggatgacgtcaagtcatcatgccccttatgtccagggcttcacgcatgctacaatggccggtacaaagagttgcgagcctgtgagggtgagcgaatctcggaaagccggtctcagttcggattggggtctgcaactcgacctcatgaagtcggagtcgctagtaatcgcagatcagcaacgctgcggtgaatacgttcccggggcttgtacacaccgcccgtcaagtcatgaaagtcggtaacacccgaagccggtggcctaaccttttgtgggggagccgtcgaaggtgggactggtaattaggactaagtcgtaacaaggtagccgtaccggaaggtgcggctggatcacctcctttctaaggag

SEQ ID NO: 10167 - DNA, 1489 bp, Scytonema hofmanni UTEX B 1581
  ref <308>: DATABASE ACCESSION NUMBER: NCBI ACCESSION: NZ_KK073768.1
  ref <309>: DATABASE ENTRY DATE: 2019-04-01
  ref <313>: RELEVANT RESIDUES IN SEQ ID NO: (1)..(1489)
aaaacggagagtttgatcctggctcaggatgaacgctggcggtatgcttaacacatgcaagtcgaacggagtacttcggtacttagtggcggacgggtgagtaacgcgtgagaatctgccttcaggttcgggacaaccactggaaacggtggctaataccgaatgtgcagcaatgtgaaatatttatagcctggagatgagctcgcgtctgattagctagtaggtgtggtaagagcgcacctaggcgacgatcagtagctggtctgagaggatgatcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaacacaatgacggtacctgaggaataagcatcggctaactccgtgccagcagccgcggtaatacggaggatgcaagcgttatccggaatgattgggcgtaaagcgtccgcaggtggctttgtaagtctgctgttaaatagtgaggcttaacctcataaaggcagtggaaactacaaggctagagtgcgttcggggcagagggaattcctggtgtagcggtgaaatgcgtagagatcaggaagaacaccggtggcgaaagcgctctgctaggccgcaactgacactgagggacgaaagctaggggagcgaatgggattagataccccagtagtcctagccgtaaacgatggatactaggcgtggcttgtatcgacccgagccgtgccgtagctaacgcgttaagtatcccgcctggggagtacgcaggcaactgtgaaactcaaaggaattgacgggggcccgcacaagcggtggagtatgtggtttaattcgatgcaacgcgaagaaccttaccaggacttgacatgtcgcgaatccctgtgaaagcagggagtgccttcgggagcgcgaacacaggtggtgcatggctgtcgtcagctcgtgtcgtgagatgttgggttaagtcccgcaacgagcgcaaccctcgtttttagttgccatcattaagttgggcactctagagagactgccggtgacaaaccggaggaaggtggggatgacgtcaagtcagcatgccccttacgttctgggctacacacgtactacaatgctacggacaaagggcagctacacagcgatgtgatgctaatctcataaaccgtagctcagttcagatcgcaggctgcaactcgcctgcgtgaaggaggaatcgctagtaattgcaggtcagcatactgcagtgaattcgttcccgggccttgtacacaccgcccgtcacaccatggaagctggtagtgcccgaagtcattaccccaaccttcgggggggggatgcctaaggcaggactggtgactggggtgaagtcgtaacaaggtagccgtaccggaaggtgtggctggatcacctccttt

SEQ ID NO: 10168 - DNA, 1490 bp, alpha proteobacterium AAP38
  ref <308>: DATABASE ACCESSION NUMBER: NCBI ACCESSION: NZ_LJHR01000029.1
  ref <309>: DATABASE ENTRY DATE: 2019-04-01
  ref <313>: RELEVANT RESIDUES IN SEQ ID NO: (1)..(1490)
aaacctgagagtttgatcctggctcagaacgaacgctggcggcaggcctaacacatgcaagtcgaacgcaccgcaaggtgagtggcgcacgggtgagtaacacgtgggaatgtaccctttggttcggaataacgtttggaaacgaacgctaataccggatgagccctacgggggaaagatttatcgccaaaggagcagcccgcgtctgattagctagttggtggggtaaaggcctaccaaggcgacgatcagtagctggtctgagaggatgatcagccacactgggactgagacacggcccagactcctacgggaggcagcagtggggaatattggacaatgggcggaagcctgatccagccatgccgcgtgagtgatgaaggccttcgggttgtaaagctctttcgcacacgacgatgatgacggtagtgtgagaagaagccccggctaacttcgtgccagcagccgcggtaatacgaagggggctagcgttgttcggaattactgggcgtaaagggcgcgtaggcggcttatcaagtcaggcgtgaaagccccgggcttaacctgggaactgcgcttgagactggtaggctagagtaccggagaggtaggtggaattcccagtgtagaggtgaaattcgtagatattgggaagaacaccagtggcgaaggcggcctactggacggtaactgacgctgaggcgcgaaagcgtggggagcaaacaggattagataccctggtagtccacgctgtaaacgatgtcggctagacgttggggcccttagggtttcagtgtcgcagctaacgcattaagccgaccgcctggggagtacggccgcaaggttgaaactcaaaggaattgacgggggcccgcacaagcggtggagcatgtggtttaattcgaagcaacgcgcagaaccttaccaacccttgacatgccttgaccgatgcagagatgcatctttcctttcggggacagggacacaggtgctgcatggctgtcgtcagctcgtgtcgtgagatgttgggttaagtcccgcaacgagcgcaacccccactgttagttgccatcattaagttgggcactctagcagaactgccggtgacaagccggaggaaggcggggatgacgtcaagtcctcatggcccttacgggttgggctacacacgtgctacaatggtggtgacagtgggcagcgaccacgcgagtggaagcgaatctccaaaagccatctcagttcggattgcactctgcaactcgggtgcatgaagttggaatcgctagtaatcgcggatcagcacgccgcggtgaatacgttcccgggccttgtacacaccgcccgtcacaccatgggagttggctttacctgaagccggtgcgctaaccgcaaggaggcagccgaccacggtacggtcagcgactggggtgaagtcgtaacaaggtagccgtaggggaacctgcggctggatcacctcctttctaaggaag

SEQ ID NO: 10169 - DNA, 1493 bp, alpha proteobacterium AAP81b
  ref <308>: DATABASE ACCESSION NUMBER: NCBI ACCESSION: NZ_LJHX01000075.1
  ref <309>: DATABASE ENTRY DATE: 2019-04-01
  ref <313>: RELEVANT RESIDUES IN SEQ ID NO: (1)..(1493)
aacttgagagtttgatcctggctcagaacgaacgctggcggcatgcctaacacatgcaagtcgaacgagaccttcgggtctagtggcgcacgggtgcgtaacgcgtgggaatctgcccaaaggtacggaataactcagggaaacttgtgctaataccgtatgatgccgagaggccaaagatttatcgcctttggatgagcccgcgttggattagctagttggtggggtaaaggcctaccaaggcgacgatccatagctggtctgagaggatgatcagccacactgggactgagacacggcccagactcctacgggaggcagcagtggggaatattggacaatgggcgaaagcctgatccagcaatgccgcgtgagtgaagaaggccttcgggttgtaaagctcttttgcccgggaagataatgactgtaccgggagaataagccccggctaactccgtgccagcagccgcggtaatacggagggggctagcgttgttcggaattactgggcgtaaagcgtacgtaggcggcttggtaagtcagaggtgaaagcccacgactcaatcgtggaactgcctttgagactgcttggcttgaacacgggagaggtgagtggaattccgagtgtagaggtgaaattcgtagatattcggaagaacaccagtggcgaaggcggctcactggaccgttgttgacgctgaggtacgaaagcgtggggagcaaacaggattagataccctggtagtccacgccgtaaacgatgagaactagctgtcggggctcttggagcttcggtggcgcagctaacgcattaagttctccgcctggggagtacggccgcaaggttaaaactcaaaggaattgacgggggcctgcacaagcggtggagcatgtggtttaattcgaagcaacgcgcagaaccttaccagcgtttgacatcgcaggacggtttccagagatggattccttctcgcaagagacctgcagacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacacgctgggctacacacgtgctacaatggcggtgacaatgggctgcaaacccgcaagggtgcgctaatctcaaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgctgctctaacccgcaagggaggaaggcgaccacggtgggtttagcgactggggtgaagtcgtaacaaggtagccgtaggggaacctgcggctggatcacctcctttctaagga

SEQ ID NO: 10170 - DNA, 1497 bp, alpha proteobacterium BAL199
  ref <308>: DATABASE ACCESSION NUMBER: NCBI ACCESSION: NZ_ABHC01000021.1
  ref <309>: DATABASE ENTRY DATE: 2019-04-01
  ref <313>: RELEVANT RESIDUES IN SEQ ID NO: (1)..(1497)
gaactcaacctgagagtttgatcctggctcagaacgaacgctggcggcatgcctaacacatgcaagtcgaacggctcttcggagcagtggcgcacgggtgagtaacgcgtgggaatctaccctgaggttcggaataacggttggaaacgaccgctaataccggatgtgccctatggggcaaaggcttgccgccttgggaggagcccgcgtccgattagcttgttggtggggtaacggcctaccaaggcgacgatcggtagctggtctgagaggatgatcagccacactgggactgagacacggcccagactcctacgggaggcagcagtggggaatattggacaatgggcgaaagcctgatccagcaatgccgcgtgtgtgacgaaggccttagggttgtaaaacactttcgccgatgacgatgatgacggtagtcggataagaagccccggctaactccgtgccagcagccgcggtaatacggagggggcgagcgttgttcggaattactgggcgtaaagggcgcgtaggcggtgacgttagtcgggcgtgaaagccccgggctcaacctgggatctgcgttcgatactgcgttacttgagagcggaagagggtagtggaattcccagtgtagaggtgaaattcgtagatattgggaagaacaccagtggcgaaggcggctacctggtccgtttctgacgctgaggcgcgaaagcgtggggagcaaacaggattagataccctggtagtccacgccgtaaacgatgaatgctagacgtcgggaaacttgtttttcggtgtcgccgctaacgcattaagcattccgcctggggagtacggccgcaaggttaaaactcaaaggaattgacgggggcccgcacaagcggtggagcatgtggtttaattcgaagcaacgcgcagaaccttaccagcccttgacatgggaagtatgggcgccggagacggtgtccttcagttcggctggcttccgcacaggtgctgcatggctgtcgtcagctcgtgtcgtgagatgttgggttaagtcccgcaacgagcgcaaccctcattgtcagttgccatcagttcggctgggcactctggcgaaactgcctgtgataagcaggaggaaggcggggatgacgtcaagtcctcatggcccttatgggctgggctacacacgtgctacaatggcggtgacagtgggcagcgaaggggcgacctggagctaatccccaaaaaccgtctcagttcggatcgcactctgcaactcgggtgcgtgaaggtggaatcgctagtaatcgcggatcagcatgccgcggtgaatacgttcccgggccttgtacacaccgcccgtcacaccatgggagttggttttacctgaagacggtgcgctaaccgcaaggaggcagccggccacggtaaggtcagcgactggggtgaagtcgtaacaaggtagccgtaggggaacctgcggctggatcacctcctttctaaggg

SEQ ID NO: 10171 - DNA, 1496 bp, alpha proteobacterium HIMB114
  ref <308>: DATABASE ACCESSION NUMBER: NCBI ACCESSION: NZ_ADAC02000001.1
  ref <309>: DATABASE ENTRY DATE: 2019-04-01
  ref <313>: RELEVANT RESIDUES IN SEQ ID NO: (1)..(1496)
attaaacttgagagtttgatcatggctcagaatgtacgctggcggcacgcctaacacatgcaagtcgagcgaggtacttgtacctagcggcagacgggtgcgtaacatgtgggaatctgccttttggttcggaacaacatggggaaacctgtgctaataccggataagtccttacggagaaagatttatcgccgaaagatgagcccgcactagattagcttgttggtaaggtaaaagcttaccaaggctacgatctatagctgatttgagaggatgatcagccacactgggactgagacacggcccagactcctacgggaggcagcagtggggaatcttgcacaatggaggaaactctgatgcagcgatgccgcgtgagtgaagaaggcccttgggttgtaaagctcttttgtcgggaaagataatgactgtacccgaagaataaggtccggctaacttcgtgccagcagccgcggtaatacgaagggacctagcgtaattcggaattactgggcgtaaagcgcgcgtaggcggttaagtaagttaattgtgaaagcccaaagctcaactttggaattgcaattaaaactatttagctagagtttatcagaggaaagcggaatacatagtgtagaggtgaaattcgtagatattatgtagaacaccagttgcgaaggcggctttctgggataacactgacgctgaggtgcgaaagtatgggtagcgaagaggattagataccctcgtagtccataccgtaaacgatgattgttagatgttggaaatttattttcagtatcacagctaacgcgttaaacaatccgcctggggagtacgaccgcaaggttaaaactcaaatgaattgacggggacccgcacaagcggtggagcatgtggtttaattcgaagctacgcgcagaaccttaccaacacttgacatgtctgtcgcggattccagagatggattccttcggttcggccggacagaacacaggtgctgcatggctgtcgtcagctcgtgtcgtgagatgttgggttaagtcccgcaacgagcgcaacccctacttctagttgccatcaggttaagctgggcactctagtaggactgcctgtgataagcaggaggaaggttgggatgacgtcaagtcctcatggcccttacgtgttgggctacacacgtgctacaatggcagtgacaatgagatgctaaacggcgacgttaagctaaactcaaaaacctgcctcagttcggattgcactctgcaactcgagtgcatgaagctggaatcgctagtaatcgctcatcagcgcggagcggtgaatacgttcccgggtcttgtacacaccgcccgtcacaccatggaagttggttttaccttaaggcatgtcactaaccctcgggaagtgcgtgaccacggtatgatcggcgactggggtgaagtcgtaacaaggtagccgtaggggaacctgcggctggattacctcctttctaagga

SEQ ID NO: 10172 - DNA, 1509 bp, alpha proteobacterium IMCC14465
  ref <308>: DATABASE ACCESSION NUMBER: NCBI ACCESSION: NZ_ALYF01000006.1
  ref <309>: DATABASE ENTRY DATE: 2019-04-01
  ref <313>: RELEVANT RESIDUES IN SEQ ID NO: (1)..(1509)
attcaaacttaagagtttgatcctggctcagaacgaacgctggcggcaggcttaacacatgcaagtcgaacgagaagcttcttcggaagtggaaagtggcagacgggtgagtaacgcgtgggaatttgcccagaggtttggaacaaccattggaaacgatggctaataccagataagcccttcgggggaaagatttatcgcctttggataagcccgcgtaagattagctagttggtgaggtaacggctcaccaaggcgacgatctttagctggtctgagaggatgatcagccacattgggactgagacacggcccagactcctacgggaggcagcagtggggaatattgcgcaatgggggaaaccctgacgcagccatgccgcgtgagtgacgaaggccttagggttgtaaagctctttcgctagggaagataatgacggtacctagtaaagaagccccggctaactccgtgccagcagccgcggtaatacggagggggctagcgttgttcggaatcactgggcgtaaagcgcgcgtaggcggattgattagttgggggtgaaatcccggggctcaacctcggaactgcctccaatactgtcagtcttgagttcgtgagaggtaagtggaattccgagtgtagaggtgaaattcgtagatattcggaagaacaccagtggcgaaggcgacttactggcacgatactgacgctgaggtgcgaaagcgtggggagcaaacaggattagataccctggtagtccacgccgtaaacgatgaatgctagctgtcggacagttaactgttcggtggcgcagctaacgcattaagcattccgcctggggagtacggtcgcaagactaaaactcaaaggaattgacgggggcccgcacaagcggtggagcatgtggtttaattcgaagcaacgcgcagaaccttaccagcccttgacatcccggtcgcggttttcagagatgaattccttcagttcggctggaccggtgacaggtgctgcatggctgtcgtcagctcgtgtcgtgagatgttgggttaagtcccgcaacgagcgcaaccctcgcctttagttgccagcatttagttgggcactctagagggactgccggtgataagccggaggaaggtggggatgacgtcaagtcctcatggcccttatgggctgggctacacacgtgctacaatggcggcgacagagggttgcgatcccgtgagggcaagctaatccccaaaagccgtctcagttcggattgttctctgcaactcgagagcatgaaggtggaatcgctagtaatcgcagatcagcatgctgcggtgaatacgttcccgggccttgtacacaccgcccgtcacaccatgggagttggttctacccgaaggtggtgcgctaaccgtaaggaggcagccaaccacggtaggattagcgactggggtgaagtcgtaacaaggtagccgtaggggaacctgcggctggatcacctcctttctaaggaattt

SEQ ID NO: 10173 - DNA, 1464 bp, alpha proteobacterium L41A; identical to SEQ ID NO: 2168
  ref <308>: DATABASE ACCESSION NUMBER: NCBI ACCESSION: NZ_AMYY01000057.1
  ref <309>: DATABASE ENTRY DATE: 2019-04-01
  ref <313>: RELEVANT RESIDUES IN SEQ ID NO: (1)..(1464)

SEQ ID NO: 10174 - DNA, 1496 bp, alpha proteobacterium LLX12A
  ref <308>: DATABASE ACCESSION NUMBER: NCBI ACCESSION: NZ_AMYX01000232.1
  ref <309>: DATABASE ENTRY DATE: 2019-04-01
  ref <313>: RELEVANT RESIDUES IN SEQ ID NO: (1)..(1496)
tcaaacttgagagtttgatcctggctcagaacgaacgctggcggcatgcctaatacatgcaagtcgaacgagatcttcggatctagtggcgcacgggtgcgtaacgcgtgggaatctgcccttgggttcggaataacttctggaaacggaagctaataccggatgatgacgtaagtccaaagatttatcgcccaaggatgagcccgcgtaggattagctagttggtggggtaaaggcccaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtggagacactttccttcagttcggctggataggtgacaggtgctgcatggctgtcgtcagctcgtgtcgtgagatgttgggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgggtttagcgactggggtgaagtcgtaacaaggtagccgtaggggaacctgcggctggatcacctcctttctaagga

SEQ ID NO: 10175 - DNA, 1509 bp, alpha proteobacterium Mf 1.05b.01
  ref <308>: DATABASE ACCESSION NUMBER: NCBI ACCESSION: NZ_BAOK01000002.1
  ref <309>: DATABASE ENTRY DATE: 2019-04-01
  ref <313>: RELEVANT RESIDUES IN SEQ ID NO: (1)..(1509)
tcaacttgagagtttgatcctggctcagaacgaacgctggcggcaggcttaacacatgcaagtcgaacgagaagctaccttcgggtagtggaaagtggcagacgggtgagtaacgcgtgggaatatacctagaggtacggaacaacgccgggaaactggtgctaataccgtatgtgcccttcgggggaaagatttatcgcctttagattagcccgcgttagattagcttgttggtgaggtaaaagctcaccaaggcgacgatctatagctggtctgagaggatgatcagccacactgggactgagacacggcccagactcctacgggaggcagcagtggggaatcttgcacaatgggcgaaagcctgatgcagccatgccgcgtgtgtgatgaaggccttagggttgtaaaacactttcagaggggaagataatgacggtaccctcagaagaagctccggctaactccgtgccagcagccgcggtaatacggagggagctagcgttgttcggaattactgggcgtaaagcgcgcgtaggcggattgattagtcagaggtgaaatcccagggctcaaccctggaactgcctttgatactgtcagtctagagaccgagagaggtgagtggaatttccagtgtagaggtgaaattcgtagatattggaaagaacaccagtggcgaaggcggctcactggctcggtactgacgctgaggtgcgaaagcgtggggagcaaacaggattagataccctggtagtccacgccgtaaacgatgagagctagttgtcaggcagtatactgtttggtgacgcagctaacgcattaagctctccgcctggggagtacggtcgcaagattaaaactcaaaggaattgacgggggcccgcacaagcggtggagcatgtggtttaattcgaagcaacgcgcagaaccttaccaacccttgacatcctgatcgcggttaccagagatggtttccttcagttaggctggatcagtgacaggtgttgcatggctgtcgtcagctcgtgtcgtgagatgttgggttaagtcccgcaacgagcgcaaccctcgcctttagttgccatcatttagttgggcactctagagggactgccggtgataagccggaggaaggtggggatgacgtcaagtcctcatggcccttatgggttgggctacacacgtgctacaatggcggcgacagagggcagcgaccccgcgagggtgagctaatctccaaaagccgtctcagttcggattgttctctgcaactcgagagcatgaaggtggaatcgctagtaatcgcagaacagcatgctgcggtgaatacgttcccgggccttgtacacaccgcccgtcacatcatgggagttggctttacccgaaggtggtgcgctaacctagcaataggaggcagccaaccacggtaaggtcagcgactgggatgaagtcgtaacaaggtagccctaggggaacctggggctggatcacctcctttctaaggaa

SEQ ID NO: 10176 - DNA, 1512 bp, alpha proteobacterium Q-1
  ref <308>: DATABASE ACCESSION NUMBER: NCBI ACCESSION: NZ_BAYV01000103.1
  ref <309>: DATABASE ENTRY DATE: 2019-04-01
  ref <313>: RELEVANT RESIDUES IN SEQ ID NO: (1)..(1512)
tcaatctgagagtttgatcctggctcagaacgaacgctggcggcaggcctaacacatgcaagtcgagcgcttccttcggggagagcggcggacgggtgagtaacgcgtgggaatctgccctgaggtacggaacaacgcatggaaacgtgcgctaataccgtatgatgttatatgattggatttgtataaccaaagatttatcgccttgggatgggcccgcgttggattagctagttggtgaggtaatggctcaccaaggcgacgatccatagctggtttgagaggatgatcagccacactgggactgagacacggcccagactcctacgggaggcagcagtggggaatattggacaatgggggcaaccctgatccagccatgccgcgtgagtgatgaaggccttagggttgtaaagctctttcgccggtgaagataatgacggtaaccggtaaagaagccccggctaactccgtgccagcagccgcggtaatacggagggggctagcgttgttcggaattactgggcgtaaagcgcacgtaggcggatgatcaagttgggggtgaaagcccggggctcaacctcggaattgccctcaaaactgatgatctagagaccgggagaggtgagtggaattcctagtgtagaggtgaaattcgtagatattaggaagaacaccagtggcgaaggcggctcactggaccggttctgacgctgaggtgcgaaagcgtggggagcaaacaggattagataccctggtagtccacgccgtaaacgatgggtgctagatgtcggggatcttagatcttcggtgtcgcagttaacgcgttaagcaccccgcctggggagtacggccgcaaggttaaaactcaaaggaattgacgggggcccgcacaagcggtggagcatgtggtttaattcgaagcaacgcgcagaaccttaccagcccttgacatctgggtcgcgggaaccggagacggtttccttcagttcggctggacccaagacaggtgctgcatggctgtcgtcagctcgtgtcgtgagatgttgggttaagtcccgcaacgagcgcaacccctacttttagttgccatcagtttggctgggcactctagaaggaccgccggtgataagccggaggaaggtggggatgacgtcaagtcctcatggcccttatgggctgggctacacacgtgctacaatggcagtgacagagggacgcgatcccgcgagggtgagcaaatctccaaaagctgtctcagttcggattgcactctgcaactcgagtgcatgaaggtggaatcgctagtaatcgtggatcagcatgccacggtgaatacgttcccgggccttgtacacaccgcccgtcacaccatgggagttggttttacccgaagacggtgagcgaacccgcaagggatgcagccggccacggtagggtcagcgactggggtgaagtcgtaacaaggtagccgtaggggaacctgcggctggatcacctcctttctaagga

SEQ ID NO: 10177 - DNA, 1469 bp, alpha proteobacterium U9-1i
  ref <308>: DATABASE ACCESSION NUMBER: NCBI ACCESSION: NZ_BBSY01000003.1
  ref <309>: DATABASE ENTRY DATE: 2019-04-01
  ref <313>: RELEVANT RESIDUES IN SEQ ID NO: (1)..(1469)
caacctgagagtttgattctggctcagaacgaacgctggcggcaggcttaacacatgcaagtcgaacgccccgcaaggggagtggcagacgggtgagtaacgcgtgggaacatgcccaaaggtacggaacaactccgggaaactggagctaataccgtatgtgcccgaaaggggaaagatttatcgcctttggattggcccgcgttggattagctagttggtggggtaaaagcctaccaaggcgacgatccatagctggtctgagaggacgaccagccacactgggactgagacacggcccagactcctacgggaggcagcagtggggaatcttggacaatgggcgcaagcctgatccagccatgccgcgtggatgatgaaggccctagggttgtaaaatcctttcgttggggacgataatgacggtacccaaagaagaagctccggctaacttcgtgccagcagccgcggtaatacgaagggggctagcgttgttcggatttactgggcgtaaagcgcgtgtaggcgggctggaaagttgggggtgaaatcccgaggctcaacctcggaactgcctccaaaacttccagcctggactcaagtagaggcaagtggaattgcgagtgtagaggtgaaattcgtagatattcgcaggaacaccagtggcgaaggcgacttgctggacttgtagtgacgctgagacgcgaaagcgtggggagcaaacaggattagataccctggtagtccacgctgtaaacgatgagagctagttgtcggcatgcatgcatgtcggtgacgcagctaacgcattaagctctccgcctggggagtacggtcgcaagattaaaactcaaagaaattgacgggggcccgcacaagcggtggagcatgtggtttaattcgaagcaacgcgcagaaccttacccacgtttgacatgtccagtttgatcggcagagatgcctttcttcacctcgggtggctggaacacaggtgctgcatggctgtcgtcagctcgtgtcgtgagatgttgggttaagtcccgcaacgagcgcaaccctcgctactagttgccatcaggttatgctgggcactctagtggaactgccggtggcaagccggaggaaggtggggatgacgtcaagtcctcatggcccttacgcgtggggctacacacgtgctacaatggcggtgacagagggataatccctaaaagccgtctcagttcggattgttctctgcaactcgagagcatgaagttggaatcgctagtaatcgcggatcagcatgccgcggtgaatacgttcccgggccttgtacacaccgcccgtcacaccatgggagttggttctacccgaaggtggtgcgctaaccgcaaggaggcagccaaccacggtagggtcagcgactggggtgaagtcgtaacaaggtagccgtaggggaacctgcggctggatcacctcctttctaa

SEQ ID NO: 10178 - DNA, 1506 bp, anaerobic bacterium MO-CFX2
  ref <308>: DATABASE ACCESSION NUMBER: NCBI ACCESSION: NZ_BFCB01000001.1
  ref <309>: DATABASE ENTRY DATE: 2019-04-01
  ref <313>: RELEVANT RESIDUES IN SEQ ID NO: (1)..(1506)
tacggagagtttgatcctggctcaggatgaacgctggcggcgtgcctaatacatgcaagtcgaacgcagagtttcatttcggtgaggctttgagtggcgcacgggtgagtaacacgtagctgacctgcccttcagagggggacaactgctggaaacggcagctaataccccgtacgctcgcgaggaccagaagactcgtgaggaaagccgaaaggtgctgaaggagggggctgcggcccatcagctagttggcagggtaacggcctaccaaggcgaggacgggtagggggcctgagagggtgaccccccacactgggactgagacacggcccagactcctacgggaggcagcagtaagggatattgcgacaatggacgaaagtctgacgcagcaacgccgcgtgcgggatgacggccttcgggttgtaaaccgcttttcggggggaagaggaaggacggtacccccggaataagtctcggctaactacgtgccagcagccgcggtaaaacgtaggaggcgagcgttatccggatttactgggtgtaaagcgcgtgcaggcggttctgcaagtcgtgcgtgaaagcgcccggctcaaccgggcgaggtcgtgcgaaactgcagagctagaggtaggtagaggcgtgtggaattccgggtgtagtggtgaaatgcgtagagatccggaggaacaccagtggcgaaggcgacacgctgggcctgacctgacgctcagacgcgaaagcatgggtagcgaacgggattagaaaccccggtagtccatgccgtaaacgatgtgaactaggtgtagcgggtgtcaaagccggctgtgccgaagctaacgtgataagttcaccacctggggactacggccgcaaggttaaaactcaaaggaattgacgggggcccgcacaagcagcggagcgtgtggtttaattcgaggctacacgaagaaccttacctgggcttgacatggcggtggtagggaaccgaaaggggaccgaccttcgggagccgtcacaggtgctgcatggctgtcgtcagctcgtgtcgtgagatgttcggttaagtccggtaacgagcgcaacccttgtcgtcagttacacgtgtctggcgagactgcccgtgcaaagcgggaggaaggtggggatgacgtcaagtcagcatggcctttatgtccagggctacacacacgctacaatggccggtacaatgggtcgccaacccgcgagggggagccaatccaaacaaagccggtctcagttcggattacaggctgcaacccgcctgtatgaagtcggagttgctagtaaccgcaggtcagctatactgcggtgaatacgttcccgggccttgtacacaccgcccgtcacgtcatgggagttggtcatgcctgaagtcggtgggctaaccgtaagggagcagccgcctagggcagggctggtgactaggacgaagtcgtaacaaggtagctgtagcggaagctgcggctggatcacctcctttct

SEQ ID NO: 10179 - DNA, 1555 bp, bacterium 0.1xD8-71
  ref <308>: DATABASE ACCESSION NUMBER: NCBI ACCESSION: NZ_RAYR01000063.1
  ref <309>: DATABASE ENTRY DATE: 2019-04-01
  ref <313>: RELEVANT RESIDUES IN SEQ ID NO: (1)..(1555)
ttataagagagtttgatcctggctcaggatgaacgctggcggcgtgcttaacacatgcaagtcgaacggagtcatcatttttgaagcaattagcttgctaagggtggaaatgttggtgacttagtggcggacgggtgagtaacgcgtgggtaacctgccatatacagggggataacacttagaaataggtgctaataccgcataagcgcacaggaccgcatggtctggagtgaaaaacattagtggtatatgatggacccgcgtctgattagctggttggtgaggtaacggcccaccaaggcgacgatcagtagccggcctgagagggtggacggccacattgggactgagacacggcccaaactcctacgggaggcagcagtgggggatattggacaatggggggaaccctgatccagcgacgccgcgtgagtgaagaagtatctcggtatgtaaagctctatcagcagggaagaaagaaatgacggtacctgagtaagaagccccggctaactacgtgccagcagccgcggtaatacgtagggggcaagcgttatccggaattactgggtgtaaagggagcgtagacggtgaagtaagtctggagtgaaaggcgggggcccaacccccggactgctctggaaactatttgactggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgatcactaggtgtcggtgggtatggacccatcggtgccgcagccaacgcagtaagtgatccacctggggagtacgttcgcaagaatgaaactcaaaggaattgacggggacccgcacaagcggtggagcatgtggtttaatccgaagcaacgcgaagaaccttaccaagtcttgacatcctcctggatacagggtaatgcctgtaggccttcgggacaggagagacaggtggtgcatggttgtcgtcagctcgtgtcgtgagatgttgggttaagtcccgcaacgagcgcaacccctatctttagtagccagcgagtaaggtcgggcactctagagagactgccggggataacccggaggaaggtggggatgacgtcaaatcatcatgccccttatgatttgggctacacacgtgctacaatggcgtaaacagagggaagcgagcctgcgagggggagcaaatcccaaaaataacgtcccagttcggattgtagtctgcaacccgactacatgaagctggaatcgctagtaatcgcggatcagaatgccgcggtgaatacgttcccgggtcttgtacacaccgcccgtcacaccatgggagtcggaaatgcccgaagtctgtgacccaaccttagggagggagcagccgaaggcaggtcggatgactggggtgaagtcgtaacaaggtagccgtatcggaaggtgcggctggatcacctcctttctaaggaa

SEQ ID NO: 10180 - DNA, 1544 bp, bacterium 0.1xD8-82
  ref <308>: DATABASE ACCESSION NUMBER: NCBI ACCESSION: NZ_RAYQ01000068.1
  ref <309>: DATABASE ENTRY DATE: 2019-04-01
  ref <313>: RELEVANT RESIDUES IN SEQ ID NO: (1)..(1544)
ttgagagtttgatcctggctcaggatgaacgctggcggcgtgcttaacacatgcaagtcgaacggggataagacatcggaagagctgcttgcagattggaagaagtcatattctagtggcggacgggtgagtaacgcgtgggcaacctgccttatacagggggataacagctggaaacagctgctaataccgcataagcgcacagtgctgcatggtacagtgtgaaaaactgaggtggtataagatgggcccgcgtctgattagctggttgggagggtaacggcctaccaaggcgacgatcagtagccggcctgagagggcggacggccacattgggactgagacacggcccagactcctacgggaggcagcagtggggaatattgcacaatggggggaaccctgatgcagcgacgccgcgtgagtgaagaagtatttcggtacgtaaagctctatcagcagggaagaaaaaaggacggtacctgagtaagaagccccggctaactacgtgccagcagccgcggtaatacgtagggggcaagcgttatccggaattactgggtgtaaagggagcgtagacggcaatgcaagtccggagtggaatgcggcagctcaactgccgaactgctctggaaactgtatggcttgagtgcaggaggggtaagcggaattcctggtgtagcggtgaaatgcgtagatatcaggaggaacaccggtggcgaaggcggcttactggactgtaactgacgttgaggctcgaaagcgtggggagcaaacaggattagataccctggtagtccacgccgtaaacgatgattactaggtgtcgcggagtcaaggctctgcggtgccgcagcaaacgcagtaagtaatccacctggggagtacgttcgcaagaatgaaactcaaaggaattgacggggacccgcacaagcggtggagcatgtggtttaattcgaagcaacgcgaagaaccttacccggtcttgacatccctgcgaagagatggtaatgcatcttgtactacggtacgcaggagacaggtggtgcatggttgtcgtcagctcgtgtcgtgagatgttgggttaagtcccgcaacgagcgcaacccctgcccccagtagccagcatgtaaaggtgggcactctgaggggacagccggggataacccggaggaaggcggggatgacgtcaaatcatcatgccccttatgaccggggctacacacgtgctacaatggcgtaaacaaagggaagcgagagtgcgagcttaagcgaaccccaaaaataacgcctcagttcggattgcagcctgcaactcggctgcatgaagttggaatcgctagtaatcgcggatcagaatgccgcggtgaatacgttcccgggtcttgtacacaccgcccgtcacaccatgggagtcgggaatgcccgaagtcggtgacctaaccgaaagggaggagccgccgaaggcaggcctggtaactggggtgaagtcgtaacaaggtagccgtatcggaaggtgcggctggatcacctcctttctaagg

SEQ ID NO: 10181 - DNA, 1314 bp, bacterium 1XD21-70
  ref <308>: DATABASE ACCESSION NUMBER: NCBI ACCESSION: NZ_RAYB01000108.1
  ref <309>: DATABASE ENTRY DATE: 2019-04-01
  ref <313>: RELEVANT RESIDUES IN SEQ ID NO: (1)..(1314)
ctccggtggtatgggatggacccgcgtctgattagctagttggaggggtaacggcccaccaaggcgacgatcagtagccgacctgagagggtgaccggccacattgggactgagacacggcccaaactcctacgggaggcagcagtggggaatattgcacaatgggggaaaccctgatgcagcaacgccgcgtgagtgaagaagtatctcggtatgtaaagctctatcagcagggaagaagatgacggtacctgagtaagaagccccggctaactacgtgccagcagccgcggtaatacgtagggggcaagcgttatccggatttactgggtgtaaagggagcgtagacggccaggcaagtctggagtgaaagcccggggctcaaccccgggactgctttggaaactgccaggctggagtgctggagaggcaagcggaattcctagtgtagcggtgaaatgcgtagatattaggaagaacaccagtggcgaaggcggcttgctggacagtaactgacgttgaggctcgaaagcgtggggagcaaacaggattagataccctggtagtccacgccgtaaacgatgaatgctaggtgttggggagcaaagcttcccggtgccgccgcaaacgcaataagcattccacctggggagtacgttcgcaagaatgaaactcaaaggaattgacggggacccgcacaagcggtggagcatgtggtttaattcgaagcaacgcgaagaaccttaccaagtcttgacatcccggtggcgcatgcagaaatgcatgctctcttcggagcgctggagacaggtggtgcatggttgtcgtcagctcgtgtcgtgagatgttgggttaagtcccgcaacgagcgcaacccttatccttagtagccagcaggcaaggctgggcactctagggagactgccagggataacctggaggaaggtggggatgacgtcaaatcatcatgccccttatgatttgggctacacacgtgctacaatggcgtaaacaaagggaggcgaagccgcgaggccgagcgaaccccaaaaataacgtcccagttcggattgcaggctgcaacccgcctgcatgaagccggaatcgctagtaatcgcagatcagaatgctgcggtgaatacgttcccgggtcttgtacacaccgcccgtcacaccatgggagtcgataacgcccgaagtcagtgacccaaccggaaggggggagctgccgaaggcgggatggataactggggtgaagtcgtaacaaggtagccgtatcggaaggtgcggctggatcacctcctttctagggaa

SEQ ID NO: 10182 - DNA, 1518 bp, bacterium 1XD42-1
  ref <308>: DATABASE ACCESSION NUMBER: NCBI ACCESSION: NZ_RAZJ01000084.1
  ref <309>: DATABASE ENTRY DATE: 2019-04-01
  ref <313>: RELEVANT RESIDUES IN SEQ ID NO: (1)..(1518)
ttaacaaagagtttgatcctggctcaggacgaacgctggcggcgcgcctaacacatgcaagtcgaacgggaccattttagagtttactttgagatggtttagtggcggacgggtgagtaacacgtgagcaacctacctttcagagggggataacagttggaaacgactgctaataccgcataacgttgtaaaagggcatccatttacaaccaaaagagaaatctgctgaaagatgggctcgcggccgattagatagtaggcggggtaacggcccacctagtcaacgatcggtagccggactgagaggttgaacggccacattgggactgagacacggcccagactcctacgggaggcagcagtgggggatattgcacaatgggcgaaagcctgatgcagcgacgccgcgtgagggaagacggtcttcggattgtaaacctctgtctttggggaagaatagagacggtacccaaagaggaagctccggctaactacgtgccagcagccgcggtaatacgtagggagcgagcgttgtccggaattactgggtgtaaagggagcgtaggcgggcttgtaagttgaatgtctaatccaccggctcaaccggtgatcgcgttcaaaactgcaggtcttgagtgaagtagaggcaggcggaattcctagtgtagcggtgaaatgcgtagatattaggaggaacaccagtggcgaaggcggcctgctgggctttaactgacgctgaggctcgaaagcgtggggagcaaacaggattagataccctggtagtccacgccgtaaacgatgattactaggtgtggggagatcaaactttccgtgccggagtaaacacaataagtaatccacctggggagtacggccgcaaggttgaaactcaaaggaattgacgggggcccgcacaagcagtggagtatgtggtttaattcgaagcaacgcgaagaaccttaccaggtcttgacatctcctgaatagcctagagataggtgaagcccttcggggcaggaagacaggtggtgcatggttgtcgtcagctcgtgtcgtgagatgttgggttaagtcccgcaacgagcgcaacccttattattagttgctacgcaagagcactctaatgagactgccgttgacaaaacggaggaaggtggggatgacgtcaaatcatcatgccccttatgacctgggctacacacgtactacaatggcactaaaacagagggaagcgacaccgcgaggtgaagcaaatcccgaaaaagtgtctcagttcggatcgcaggctgcaacccgcctgcgtgaagtcggaattgctagtaatcgcagatcagcatgctgcggtgaatacgttcccgggccttgtacacaccgcccgtcacaccatgggagtcggtaacacccgaagccagtagctgaaccgtaagggaggcgctgtcgaaggtgggattgatgactggggtgaagtcgtaacaaggtagccgtatcggaaggtgcggctggatcacctcctttcta

SEQ ID NO: 10183 - DNA, 1411 bp, bacterium 1XD42-44
  ref <308>: DATABASE ACCESSION NUMBER: NCBI ACCESSION: NZ_RAZI01000077.1
  ref <309>: DATABASE ENTRY DATE: 2019-04-01
  ref <313>: RELEVANT RESIDUES IN SEQ ID NO: (1)..(1411)
tttttggagagtttgatcttggctcaggacgaacgctggcggcgtgcctaatacatgcaagtcgagcgcgggaagcaagcagaactccttcgggagtgacgcttgtggaacgagcggcggacgggtgagtaacacgtgggcaacctacctgtaagactgggataactccgggaaaccggggctaataccggatgatacatgtcgtcgcatgacgagatgttaaaaaggcggcatatgctgtcacttacagatgggcctgcggcgcattagctagttggtgagataaaagctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtgccattcgaataggttggcaccttgacggtacctaaccagaaagccccggctaactacgtgccagcagccgcggtaatacgtagggggcaagcgttgtccggaattattgggcgtaaagcgcgcgcaggcggtcctttaagtctgatgtgaaagcccacggcttaaccgtggagggccattggaaactgggggacttgagtacagaagaggagagtggaattccacgtgtagcggtgaaatgcgtagagatgtggaggaacaccagtggcgaaggcgactctctggtctgtaactgacgctgaggtgcgaaagcgtgggtagcgaacaggattagataccctggtagtccacgccgtaaacgatgagtgctaggtgttagggggtttccgccccttagtgctgaagttaacgcattaagcactccgcctggggagtacggccgcaaggctgaaactcaaaagaattgacggggacccgcacaagcggtggagcatgtggtttaattcgaagcaacgcgaagaaccttaccaggtcttgacatcctctgacgcccctagagatagggagttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggaacaaagggcagcgaagccgcgaggccaagcaaatcccataaaaccattctcagttcggattgcaggctgcaactcgcctgcatgaagccggaatcgctagtaatcgcggatcagcatgccgcggtgaatacgttcccggg

SEQ ID NO: 10184 - DNA, 1540 bp, bacterium 1XD42-54
  ref <308>: DATABASE ACCESSION NUMBER: NCBI ACCESSION: NZ_RAZH01000026.1
  ref <309>: DATABASE ENTRY DATE: 2019-04-01
  ref <313>: RELEVANT RESIDUES IN SEQ ID NO: (1)..(1540)
tttattagagagtttgatcctggctcaggatgaacgctggcggcgtgcttaacacatgcaagtcgaacgaagcattttaaatgagactttcgggtggattttaaaatgactgagtggcggacgggtgagtaacgcgtgggcaacctgccttacacagggggacaacagttagaaatgactgctaataccgcataagcgcacgggaacgcatgtttctgtgtgaaaaactccggtggtgtaagatgggcccgcgttggattaggtagttggtgaggtaacggctcaccaagccgacgatccatagccgacctgagagggtgaccggccacattgggactgagacacggcccaaactcctacgggaggcagcagtggggaatattgcacaatgggcgcaagcctgatgcagcgacgccgcgtgagcgaagaagtatttcggtatgtaaagctctatcagcagggaagaaaatgacggtacctgactaagaagctccggctaaatacgtgccagcagccgcggtaatacgtatggagcaagcgttatccggaattactgggtgtaaagggagcgtagacggatgtgcaagtctgatgtgaaaggcgggggctcaacccctggactgcattggaaactgtaaatcttgagtgccggagaggtaagcggaattcctagtgtagcggtgaaatgcgtagatattaggaggaacaccagtggcgaaggcggcttactggacggtaactgacgttgaggctcgaaagcgtggggagcaaacaggattagataccctggtagtccacgcggtaaacgatgaatactaggtgttggggagcaaagctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatccctctgacagacgagtaacgtcgtccttccttcgggacagaggagacaggtggtgcatggttgtcgtcagctcgtgtcgtgagatgttgggttaagtcccgcaacgagcgcaacccttatctttagtagccagcattatggatgggcactctagagagactgccagggataacctggaggaaggtggggatgacgtcaaatcatcatgccccttatgatttgggctacacacgtgctacaatggcgtaaacaaagggaagcgagcctgcgagggggagcaaatcccaaaaataacgtcccagttcggactgcagtctgcaactcgactgcacgaagctggaatcgctagtaatcgcgaatcagaatgtcgcggtgaatacgttcccgggtcttgtacacaccgcccgtcacaccatgggagtcggtaacgcccgaagtcagtgacccaaccgaaaggagggagctgccgaaggcgggactggtaactggggtgaagtcgtaacaaggtagccgtatcggaaggtgcggctggatcacctcctttctaaggaa

SEQ ID NO: 10185 - DNA, 1543 bp, bacterium 1XD42-8
  ref <308>: DATABASE ACCESSION NUMBER: NCBI ACCESSION: NZ_RAYU01000297.1
  ref <309>: DATABASE ENTRY DATE: 2019-04-01
  ref <313>: RELEVANT RESIDUES IN SEQ ID NO: (1)..(1543)
aaacaagagagtttgatcctggctcaggatgaacgctggcggtgcgcctaacacatgcaagtcgaacgaaggattgtgaaggaactttacggagggaaaacacaatgactgagtggcggacgggtgagtaacgcgtagggaacctggcccttacagggggataacagatggaaacaactgctaataccgcataagcgcccagcctcgcatgaggcagagtgaaaaactaaggtggtaagggatggccctgcgtccgattagctagttggtatggtaacggcataccaaggcgacgatcggtagccggcctgagagggtggacggccacattgggactgagacacggcccaaactcctacgggaggcagcagtgggggatattgcacaatgggggaaaccctgatgcagcgacaccgcgtgggtgaggaagcgcttcggcgtgtaaagccctatcagtggggaagaaaaaggacggtacccaaagaagaagcaccggctaaatacgtgccagcagccgcggtaatacgtatggtgcaagcgttatccggaatgactgggtgtaaagggagcgtagacggttgtacaagtctgatgtgaaagcccacggctcaactgtgggagtgcattggaaactgtagaactagagtatcggagaggcaagtggaattcctagtgtagcggtgaaatgcgtagatattaggaggaacaccagtggcgaaggcggcttgctggacgaaaactgacgttgaggctcgaaagcgtggggagcaaacaggattagataccctggtagtccacgctgtaaacgatgaatactaggtgttggggcccgaagggcgtcggtgccgtcgcaaacgcagtaagtattccacctggggagtacgttcgcaagaatgaaactcaaaggaattgacggggacccgcacaagcggtggagcatgtggtttaattcgaagcaacgcgaagaaccttaccaagccttgacatccctctgaatagactgtaatgagtctagcccttcggggcagaggagacaggtggtgcatggttgtcgtcagctcgtgtcgtgagatgttgggttaagtcccgcaacgagcgcaacccttgttctcagtagccagcagggaaggctgggcactctggggagactgccggggagaacccggaggaaggcggggacgacgtcaaatcatcatgccccttatggcttgggctacacacgtgctacaatggcggtgacaaagggaggcgaacttgcgagagggagcgaacctcaaaaacaccgtcacagttcggattgtagtctgcaactcgactacatgaagccggaatcgctagtaatcgcagatcagcatgctgcggtgaatacgttcccgggtcttgtacacaccgcccgtcacaccatgggagtgggagacgcccgaagccggtgaccgaacccgaaaggggcggagccgtcgaaggtggggctcatgactggggtgaagtcgtaacaaggtagccgtatcggaaggtgcggctggatcacctcctttctagggaa

SEQ ID NO: 10186 - DNA, 1550 bp, bacterium 1XD8-76
  ref <308>: DATABASE ACCESSION NUMBER: NCBI ACCESSION: NZ_RAZE01000040.1
  ref <309>: DATABASE ENTRY DATE: 2019-04-01
  ref <313>: RELEVANT RESIDUES IN SEQ ID NO: (1)..(1550)
aaacaagagagtttgatcctggctcaggatgaacgctggcggcgtgcttaacacatgcaagtcgaacggagttatcatttttgaagcaaatagcttgctaggagtggagatgttgataacttagtggcggacgggtgagtaacgcgtgggtaacctgccgtatacagggggataacacttagaaataggtgctaataccgcataagcgcacagttctgcatgggacagtgtgaaaaactgaggtggtatacgatggacccgcgtctgattagccagttggcagggtaacggcctaccaaagcgacgatcagtagccggcctgagagggcggacggccacattgggactgagacacggcccaaactcctacgggaggcagcagtgggggatattgcacaatgggggaaaccctgatgcagcgacgccgcgtgagtgaagaagtatttcggtatgtaaagctctatcagcagggaagaagatgacagtacctgagtaagaagccccggctaactacgtgccagcagccgcggtaatacgtagggggcaagcgttatccggatttactgggtgtaaagggagcgtagacggatggataagtctgaagtgaaagcccgcggctcaactgcgggactgctttggaaactgtgcatcttgagtacgggaggggcaggcggaattcctggtgtagcggtgaaatgcgtagatatcaggaggaacaccggcggcgaaggcggcctgctggaccgaaactgacgttgaggctcgaaagcgtggggagcaaacaggattagataccctggtagtccacgccgtaaacgatgaatactaggtgtgaggggactaagtctcctggtgccgaagcaaacgcattaagtattccacctggggagtacgttcgcaagaatgaaactcaaaggaattgacggggacccgcacaagcggtggagcatgtggtttaattcgaagcaacgcgaagaaccttaccaggccttgacatccgcatgacgcatgggtaatgccatgtttccttcgggacatgcgagacaggtggtgcatggttgtcgtcagctcgtgtcgtgagatgttgggttaagtcccgcaacgagcgcaacccctgtttcctgtagccagcatttcggatggggactcaggagagactgcccgggagaaccgggaggaaggcggggatgacgtcaaatcatcatgccccttatggtctgggctacacacgtgctacaatggcgtaaacaaagggaagcgagcctgcgagggtaagcgaatcccaaaaataacgtcccagttcggattgcagtctgcaactcgagtgcatgaagctggaatcgctagtaatcgcggatcagaatgccgcggtgaatacgttcccgggtcttgtacacaccgcccgtcacaccatgggagtcgggaatgcccgaagccggtggcccaatcgaaagaagggagccgtcgaaggcaggccggatgactggggtgaagtcgtaacaaggtagccgtatcggaaggtgcggctggatcacctcctttctaaggaa

SEQ ID NO: 10187 - DNA, 1539 bp, bacterium 1XD8-92
  ref <308>: DATABASE ACCESSION NUMBER: NCBI ACCESSION: NZ_QZFS01000248.1
  ref <309>: DATABASE ENTRY DATE: 2019-04-01
  ref <313>: RELEVANT RESIDUES IN SEQ ID NO: (1)..(1539)
ttattgagagtttgatcctggctcaggatgaacgctggcggcgtgcctaacacatgcaagtcgaacggggtatataagcggaagtttacggatggaaggttatatacttagtggcggacgggtgagtaacgcgtgggcaacctgccccgtgccgggggataccgcctggaaacaggcgctaataccgcataagcgcatacagccgcatgggtgtatgcggaaagctccggcggcacgggatgggcccgcgcccgattagccagttggcggggtaacggcccaccaaagcgacgatcggtagccggcctgagagggcggacggccacattgggactgagacacggcccaaactcctacgggaggcagcagtggggaatattgcacaatgggggaaaccctgatgcagcaacgccgcgtgggtgaaggagcgtttcggcgcgtaaagccctgtcagcggggaagaagaaagacggtacccgaccaagaagccccggctaactacgtgccagcagccgcggtaatacgtagggggcgagcgttatccggaattactgggtgtaaagggagcgtagacggcgaggtaagcctgaagtggaagcccgcggcccaaccgcggaactgctttgggaactgttttgctggagtatgggaggggtaagcggaattcctggtgtagcggtgaaatgcgtagatatcaggaggaacaccggtggcgaaggcggcttactggaccataactgacgttgaggctcgaaagcgtggggagcgaacaggattagataccctggtagtccacgccgtaaacgatgattaccaggtgtcgggtgtcgaaggacggccggtgccgcagcgaacgcagtaagtaatccacctggggagtacgttcgcaagaatgaaactcaaaggaattgacggggacccgcacaagcggtggagcatgtggtttaattcgaagcaacgcgaagaaccttacccggccttgacatcccctggacagcatatgtaatgtatgtttccttcgggaccagggagacaggtggtgcatggttgtcgtcagctcgtgtcgtgagatgttgggtcaagtcccgcaacgagcgcaacccctgcccccagtagccagcatttaagatgggcactctggggggactgccggggataacccggaggaaggcggggatgacgtcaaatcatcatgccccttatggccggggctacacacgtgctacaatggcgtaaacagagggaggcgagacagcgatgttaagcgaaccccaaaaataacgtcccagttcggattgcagcctgcaactcggctgcatgaagctggaatcgctagtaatcgcggatcagaatgccgcggtgaatacgttcccgggtcttgtacacaccgcccgtcacaccatgggagccgggaatgcccgaagtctgtgaccgaacccggaaggggaggggcagccgaaggcaggcccggtgactggggtgaagtcgtaacaaggtagccgtatcggaaggtgcggctggatcacctcctttctaagg

SEQ ID NO: 10188 - DNA, 1545 bp, bacterium 1xD42-87
  ref <308>: DATABASE ACCESSION NUMBER: NCBI ACCESSION: NZ_RAYM01000113.1
  ref <309>: DATABASE ENTRY DATE: 2019-04-01
  ref <313>: RELEVANT RESIDUES IN SEQ ID NO: (1)..(1545)
tttaagagagtttgatcctggctcaggatgaacgctggcggcgtgcttaacacatgcaagtcgaacggggattacacggtgatgcgatttcggtcaaatcaagtgcaatcttagtggcggacgggtgagtaacgcgtgggtaacctgccttgcactgggggataacacttagaaataggtgctaataccgcataagcgcacggtcctgcatgggacagtgtgaaaaactccggtggtgcaagatggacccgcgtctgattagctggttggcggggtaaaggcccaccaaggcgacgatcagtagccggcctgagagggtggacggccacattgggactgagacacggcccaaactcctacgggaggcagcagtgggggatattggacaatggggggaaccctgatccagcgacgccgcgtgagtgaagaagtatttcggtatgtaaagctctgtcagcagggaagaaagcaatgacggtacctgaccaagaagccccggctaactacgtgccagcagccgcggtaatacgtagggggcaagcgttatccggaattactgggtgtaaagggagcgtagacggctgtgcaagtctggagtgaaaggcgggggcccaacccccggactgctctggaaactgtatggctggagtgcaggagaggtaagcggaattcctagtgtagcggtgaaatgcgtagatattaggaggaacaccagtggcgaaggcggcttactggactgtaactgacgttgaggctcgaaagcgtggggagcaaacaggattagataccctggtagtccacgccgtaaacgatgattactaggtgtcggtgggtatggacccatcggtgccgcagcaaacgcagtaagtaatccacctggggagtacgttcgcaagaatgaaactcaaaggaattgacggggacccgcacaagcggtggagcatgtggtttaatccgaagcaacgcgaagaaccttaccaagtcttgacatctggatgacagggacgtaacggtccccttacttcggtacatccaagacaggtggtgcatggttgtcgtcagctcgtgtcgtgagatgttgggttaagtcccgcaacgagcgcaacccttatccttagtagccagcgggcagggccgggcactctagggagactgccggggataacccggaggaaggtggggatgacgtcaaatcatcatgccccttatgatttgggctacacacgtgctacaatggcgtaaacagagggaagcgaacccgcgagggggagcaaatcccaaaaataacgtcccagttcggattgtagcctgcaacccggctacatgaagctggaatcgctagtaatcgcggatcagaatgccgcggtgaatacgttcccgggtcttgtacacaccgcccgtcacaccatgggagtcggaaatgcccgaagtctgtgacccaaccgcaaggagggagcagccgaaggcaggtcggatgactggggtgaagtcgtaacaaggtagccgtatcggaaggtgcggctggatcacctcctttctagggaa

SEQ ID NO: 10189 - DNA, 870 bp, bacterium 1xD8-6
  ref <308>: DATABASE ACCESSION NUMBER: NCBI ACCESSION: NZ_RAYK01000217.1
  ref <309>: DATABASE ENTRY DATE: 2019-04-01
  ref <313>: RELEVANT RESIDUES IN SEQ ID NO: (1)..(870)
agtggcggacgggtgagtaacgcgtgggtaacctgccctgtacagggggacaacagccggaaacggctgctaataccgcataagcccgcggcgccgcatggcgctgcggggaaaactccggtggtacaggatgggcccgcgtctgattagctagttggcggggtaacggcccaccaaggcagcgatcagtagccggcttgagagagtggacggccacattgggactgagacacggcccagactcctacgggaggcagcagtggggaatattgcacaatggggggaaccctgatgcagcaacgccgcgtgggtgaagaagtatttcggtatgtaaagccctatcagcagggaagaagatgacggtacctgactaagaagccccggctaaatacgtgccagcagccgcggtaatacgtatggggcaagcgttatccggatttactgggtgtaaagggagcgcaggcggcgcggcaagtcagatgtgaaagcccggggctcaaccccgggactgcatttgaaactgccgtgctggagtgtcggagaggcaagtggaattcctagtgtagcggtgaaatgcgtagatattaggaggaacaccagtggcgaaggcggcttgctggacgataactgacgctgaggctcgaaagcgtggggagcaaacaggattagataccctggtagtccacgccgtaaacgatgaatactaggtgtcggggaccgacggtctccggtgccgcagcaaacgcattaagtattccacctggggagtacgttcgcaagaatgaaactcaaaggaattgacggggacccgcacaagcggtggagcatgtggtttaattcgaagcaacgcgaagaaccttaccggccctt

SEQ ID NO: 10190 - DNA, 1515 bp, bacterium 336 3
  ref <308>: DATABASE ACCESSION NUMBER: NCBI ACCESSION: NZ_LJIE01000001.1
  ref <309>: DATABASE ENTRY DATE: 2019-04-01
  ref <313>: RELEVANT RESIDUES IN SEQ ID NO: (1)..(1515)
tttacaatgaagagtttgatcctggctcaggatgaacgctagcggcgggcctaatacatgcaagtcgaacgggattggtagcaataccatgagagtggcgaacgggtgcgtaacacgtatataatctgcccattactcggggatagccttgcgaaagtgagattaatacccgatggcactgcgaggaggcatcttcttgcagttaaagaacttcggtaatggaggaatatgcgtccgattagctagttggtagtgtaacggactaccaaggctacgatcggtaggggttctgagaggatgatcccccacactggtactgagatacggaccagactcctacgggaggcagcagtagggaatattgggcaatggaggcaactctgacccagccacgccgcgtgcaggatgaaggccctctgggttgtaaactgcttttgtatgggaagaaaatgcttctgcggaagtgactgacggtaccatacgaataagcatcggctaactccgtgccagcagccgcggtaatacggaggatgcgagcgttgtccggatttactgggtttaaagggagcgtaggcgggttagtaagtgagagttgaaaggcagttgctcaacaattgtaaggctctcatactgctaatcttgagtgtactggaggcagatagaatgggtggagtagcggtgaaatgcatagataccatccagaataccgattgcgaaggcattctgctacattacaactgacgctgaggctcgaaagtgtggggatcaaacaggattagataccctggtagtccacactgtaaacgatggttactcgatgtatgcccgttagggtatgtgtccaagcgaaagcgttaagtaacccacctggggagtacgaccgcaaggttgaaactcaaaggaattgacgggggtccgcacaagcggtggagcatgtggtttaattcgatgatacgcgaggaaccttacctggtctagaatgtgagggaaggatgcagagatgtgtccgccagcaatggcccaaaacaaggtgctgcatggctgtcgtcagctcgtgccgtgaggtgttgggttaagtcccgcaacgagcgcaacccctatgattagttgctaacaggttaagctgaggactctaatcagactgcctacgcaagtagagaggaaggtggggacgacgtcaagtcatcacggcccttacgaccagggcgacacacgtgctacaatgggcgatacagagggtagctacttagcaataagatgccaatctccaaagtcgttctcagttcggattgcaggctgcaactcgcctgtatgaagctggaatcgctagtaatcgcagatcagccatgctgcggtgaatacgttcccggaccttgtacacaccgcccgtcaagccatggaagttgggtggacttgaagctggcaggtatagtgccagttagagttaaaccagtaactggggctaagtcgtaacaaggtagccgtaccggaaggtgtggctggaacacctccttt

SEQ ID NO: 10191 - DNA, 1553 bp, bacterium C-53
  ref <308>: DATABASE ACCESSION NUMBER: NCBI ACCESSION: NZ_RAZD01000058.1
  ref <309>: DATABASE ENTRY DATE: 2019-04-01
  ref <313>: RELEVANT RESIDUES IN SEQ ID NO: (1)..(1553)
gaaaacgagagtttgatcctggctcaggatgaacgctggcggcgtgcttaacacatgcaagtcgaacgggggtgcagggaacggagcgagtagtttactatgaacgaagtatcctgtatcttagtggcggacgggtgagtaacgcgtgggtaacctgccatatacagggggataacagcgagaaattgctgctaaaaccgcataagcgcacggagtcgcatgactcagtgtgaaaaactccggtggtatatgatggacccgcgtctgattagccagttggcagggtaacggcctaccaaagcgacgatcagtagccggcctgagagggtggacggccacattgggactgagacacggcccaaactcctacgggaggcagcagtggggaatattgcacaatgggggaaaccctgatgcagcgacgccgcgtgagtgaagaagtaattcgttatgtaaagctctatcagcagggaagaaaagagacggtacctgactaagaagccccggctaactacgtgccagcagccgcggtaatacgtagggggcaagcgttatccggatttactgggtgtaaagggagcgcagacggcacagcaagtctggagtgaaagcccgcggctcaaccgcgggactgctctggaaactgttgagcttgagtgcaggagaggcaggcggaattcctagtgtagcggtgaaatgcgtagatattaggaggaacaccagtggcgaaggcggcctgctggactgtaactgacgttgaggctcgaaagcgtggggagcaaacaggattagataccctggtagtccacgccgtaaacgatgatcactaggtgtcggggagtcaggactcttcggtgccgaagccaacgcattaagtgatccacctggggagtacgttcgcaagaatgaaactcaaaggaattgacggggacccgcacaagcggtggagcatgtggtttaattcgaagcaacgcgaagaaccttacctgggcttgacatccccctgagagacgggcaatgccgtcgttccttcgggacaggggagacaggtggtgcatggttgtcgtcagctcgtgtcgtgagatgttgggttaagtcccgcaacgagcgcaacccttatcttcagtagccagcaggtaaagctggggactctggagagactgccggggataacccggaggaaggcagggatgacgtcaaatcatcatgccccttatgtccagggctacacacgtgctacaatggcgtaaacaaagggaagcgaaggggtgacccggagcgaatcccaaaaataacgtctcagttcggattgtagtctgcaactcgactacatgaagccggaatcgctagtaatcgcggatcagaatgccgcggtgaatacgttcccgggtcttgtacacaccgcccgtcacaccatgggagttgttaacgcccgaagccggtggccgaacctgaaaaggagggagccgtcgaaggcgggaacaataactggggtgaagtcgtaacaaggtagccgtatcggaaggtgcggctggatcacctcctttctaagg

SEQ ID NO: 10192 - DNA, 1542 bp, bacterium CAVE-383
  ref <308>: DATABASE ACCESSION NUMBER: NCBI ACCESSION: NZ_REGP01000008.1
  ref <309>: DATABASE ENTRY DATE: 2019-04-01
  ref <313>: RELEVANT RESIDUES IN SEQ ID NO: (1)..(1542)
agattaaactgaagagtttgatcctggctcagattgaacgctggcggcatgccttacacatgcaagtcgaacggtaacagggagcttgctccgctgacgagtggcgaacgggtgagtaatatatcggaacgtgccctggagtgggggataactagtcgaaagattagctaataccgcatacgatctcaggatgaaagtgggggattcgcaagaacctcatgctcgtggagcggccgatatctgattagctagttggtagggtaaaagcctaccaaggcatcgatcagtagctggtctgagaggacgaccagccacactgggactgagacacggcccagactcctacgggaggcagcagtggggaattttggacaatgggcgcaagcctgatccagcaatgccgcgtgagtgaagaaggccttcgggttgtaaagctcttttgtcagggaagaaacggattgggctaatatcctggtctaatgacggtacctgaagaataagcaccggctaactacgtgccagcagccgcggtaatacgtagggtgcgagcgttaatcggaattactgggcgtaaagcgtgcgcaggcggttatgtaagacagatgtgaaatgcccgggcttaacctgggaactgcatttgtgactgcatggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatcctgaagagatttgggagtgctcgaaagagaaccatcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggctgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtaggtagcctaaccgcaaggagggcgcttaccacggtaggattcgtgactggggtgaagtcgtaacaaggtagccgtatcggaaggtgcggctggatcacctcctttctag

SEQ ID NO: 10193 - DNA, 1415 bp, bacterium D16-34
  ref <308>: DATABASE ACCESSION NUMBER: NCBI ACCESSION: NZ_RAZB01000022.1
  ref <309>: DATABASE ENTRY DATE: 2019-04-01
  ref <313>: RELEVANT RESIDUES IN SEQ ID NO: (1)..(1415)
tggagagtttgatcctggctcaggacgaacgctggcggcgtgcctaatacatgcaagtcgagcggacggatgggagcttgctcccagaagttagcggcggacgggtgagtaacacgtgggcaacctgccctatagttggggataactccgggaaaccggggctaataccgaatgatataatttagctcctgctagattgttgaaagatggtttacgctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagccctcggctcaaccgaggagggtcattggaaactggaggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccgctgaccgctctggagacagagcttcccttcggggcagcggtgacaggtggtgcatggttgtcgtcagctcgtgtcgtgagatgttgggttaagtcccgcaacgagcgcaacccttgtccttagttgccatcattaagttgggcactctaaggagactgccgatgacaaatcggaggaaggtggggatgacgtcaaatcatcatgccccttatgacctgggctacacacgtgctacaatggacggtacaaacggttgcgaagtcgcgagatggagctaatctgataaaaccgttctcagttcggattgtaggctgcaactcgcctacatgaagctggaatcgctagtaatcgcggatcagcatgccgcggtgaatacgttcccgggccttgtacacaccgcccgtcacacca

SEQ ID NO: 10194 - DNA, 935 bp, bacterium D16-36
  ref <308>: DATABASE ACCESSION NUMBER: NCBI ACCESSION: NZ_RAYF01000202.1
  ref <309>: DATABASE ENTRY DATE: 2019-04-01
  ref <313>: RELEVANT RESIDUES IN SEQ ID NO: (1)..(935)
tttaacatgagagtttgatcctggctcaggatgaacgctggcggcgtgcctaacacatgcaagtcgaacggggcctgcgcagcggaaccctccggggggaagcagcgcagtgcccagtggcggacgggtgagtaacgcgtgggtaacctgccctgtacagggggacaacagccggaaacggctgctaataccgcataagcccgcggcgccgcatggcgctgcggggaaaactccggtggtacaggatgggcccgcgtctgattagctagttggcggggtaacggcccaccaaggcagcgatcagtagccggcttgagagagtggacggccacattgggactgagacacggcccagactcctacgggaggcagcagtggggaatattgcacaatggggggaaccctgatgcagcaacgccgcgtgggtgaagaagtatttcggtatgtaaagccctatcagcagggaagaagatgacggtacctgactaagaagccccggctaaatacgtgccagcagccgcggtaatacgtatggggcaagcgttatccggatttactgggtgtaaagggagcgcaggcggcgcggcaagtcagatgtgaaagcccggggctcaaccccgggactgcatttgaaactgccgtgctggagtgtcggagaggcaagtggaattcctagtgtagcggtgaaatgcgtagatattaggaggaacaccagtggcgaaggcggcttgctggacgataactgacgctgaggctcgaaagcgtggggagcaaacaggattagataccctggtagtccacgccgtaaacgatgaatactaggtgtcggggaccgacggtctccggtgccgcagcaaacgcattaagtattccacctggggagtacgttcgcaagaatgaaactcaaaggaattgacggggacccgcacaagcgg

SEQ ID NO: 10195 - DNA, 1550 bp, bacterium D16-50
  ref <308>: DATABASE ACCESSION NUMBER: NCBI ACCESSION: NZ_RAZA01000093.1
  ref <309>: DATABASE ENTRY DATE: 2019-04-01
  ref <313>: RELEVANT RESIDUES IN SEQ ID NO: (1)..(1550)
atgagagtttgatcctggctcaggatgaacgctggcggcgtgcctaacacatgcaagtcgaacgggccgcgcctgaaacctagtgaaggcgcggccagtggcggacgggtgagtaacgcgtgggcaacctgccgcgcacagggggacaacggccggaaacggccgctaataccgcatattcccgcggggccgcatggccctgcggggaaagcccggggcgacccggacggtgcgcgatgggcccgcgtccgattagctagttggcggggcagcggcccaccaaggcgacgatcggtagccggcctgagagggcggacggccacactgggactgagacacggcccagactcctgcgggaggcagcagtggggaatattgcacaatggggggaaccctgatgcagcgacgccgcgtgggtgaaggagcacctcggtgcgtaaagccctatcggcagggaagaaaagcgaacaggttcgcctggacggtacctgactaagaagccccggctaactacgtgccagcagccgcggtaatacgtagggggcaagcgttatccggattcactgggtgtaaagggagcgtagacggcgacgcaagtctggagtgaaagcccggggcccaaccccgggactgctctggaaactgcgtcgctggagtacgggaggggcaggcggaattcctggtgtagcggtgaaatgcgtagatatcaggaggaacaccggcggcgaaggcggcctgctggaccgtgactgacgttgaggctcgagagcgtggggagcaaacaggattagataccctggtagtccacgccgtaaacgatgactgctaggtgtcgggggacgacagtgccccggtgccgccgcaaacgcagtaagcagtccacctggggagtacgttcgcaagaatgaaactcaaaggaattgacggggacccgcacaagcggtggagcatgtggtttaattcgaggcaacgcgaagaaccttacccagccttgacatcccggcgagaacggggcaatgcccgttgcccttcggggcgccggagacaggtggtgcatggttgtcgtcagctcgtgtcgtgagatgttgggtcaagtcccgcaacgagcgcaacccctgcccccagtagccagcgtagaggcgggcactctggggggactgccggggacaacccggaggaaggcggggacgacgtcaaatcatcatgccccttacggctggggctacacacgtgctacaatggggccgacagagggaggcggacgcgcgagcgcgagcggaccccaaaaacggccccccagttcggattgcagcctgcaactcggctgcatgaagccggaatcgctagtaatcgcggatcagaacgccgcggtgaatacgttcccgggtcttgtacacaccgcccgtcacaccatgggagcctggaatgcccgaagccggtggccgaaccgagagggcggagccgcctaaggcaggcccggtgactggggtgaagtcgtaacaaggtagccgtatcggaaggtgcggctggatcacctcctttctagggaa

SEQ ID NO: 10196 - DNA, 1540 bp, bacterium D16-51
  ref <308>: DATABASE ACCESSION NUMBER: NCBI ACCESSION: NZ_RAYE01000107.1
  ref <309>: DATABASE ENTRY DATE: 2019-04-01
  ref <313>: RELEVANT RESIDUES IN SEQ ID NO: (1)..(1540)
ttaatatgagagtttgatcctggctcaggatgaacgctggcggcgtgcctaacacatgcaagtcgaacgaagactgtatgacggaactctccggagggaagacatgcaggactgagtggcggacgggtgagtaacgcgtgggtaacctgccctgtacagggggacaacagctggaaacggctgctaataccgcataagcctgcggtgccgcatggcacagcaggaaaaactccggtggtacaggatgggcccgcgtctgattagttagttggcagggtaacggcctaccaagacgacgatcagtagccggcttgagagagtggacggccacattgggactgagacacggcccaaactcctacgggaggcagcagtggggaatattgcacaatggggggaaccctgatgcagcaacgccgcgtgagtgaagaagtatttcggtatgtaaagctctatcagcagggaagaaaatgacggtacctgactaagaagctccggctaaatacgtgccagcagccgcggtaatacgtatggagcaagcgttatccggatttactgggtgtaaagggagcgcaggcggtgcggcaagtctgatgtgaaagcccggggcccaaccccgggactgcattggaaactgccgcactagagtgccggagaggtaagtggaattcctagtgtagcggtgaaatgcgtagatattaggaggaacaccagtggcgaaggcggcttactggacggtaactgacgctgaggctcgaaagcgtggggagcaaacaggattagataccctggtagtccacgccgtaaacgatgaatactaggtgtcggggcacaacgtgcttcggtgccgcagctaacgcattaagtattccacctggggagtacgttcgcaagaatgaaactcaaaggaattgacggggacccgcacaagcggtggagcatgtggtttaattcgaagcaacgcgaagaaccttaccagcccttgacatcctgctgacagccccgtaacgggggccttcctccgggacagcagagacaggtggtgcatggttgtcgtcagctcgtgtcgtgagatgttgggttaagtcccgcaacgagcgcaacccctattgccagtaaccagcatttcggatggggactctggtgagactgccggggataacccggaggaaggtggggacgacgtcaaatcatcatgccccttatgggctgggctacacacgtgctacaatggtgctgacagagtgaggcgaacctgtgaaggggagcaaagcacaaaaaaggcacctcagttcggattgtagtctgcaacccggctacatgaagctggaatcgctagtaatcgcagatcagaatgctgcggtgaatacgttcccgggtcttgtacacaccgcccgtcacaccatgggagttgggaatgcccgaagtcagtgacccaaccgcaaggagggagctgccgaaggcaggctcgataactggggtgaagtcgtaacaaggtagccgtatcggaaggtgcggctggatcacctcctttctaagg

SEQ ID NO: 10197 - DNA, 1540 bp, bacterium D16-54
  ref <308>: DATABASE ACCESSION NUMBER: NCBI ACCESSION: NZ_RAYZ01000103.1
  ref <309>: DATABASE ENTRY DATE: 2019-04-01
  ref <313>: RELEVANT RESIDUES IN SEQ ID NO: (1)..(1540)
taatttgagagtttgatcctggctcaggatgaacgctggcggcgtgcttaacacatgcaagtcgaacgaagcggttgagaggaagttttcggatggaatttcaattgactgagtggcggacgggtgagtaacgcgtgggtaacctgcctcatacagggggataacagttagaaatgactgctaataccgcataagcgcacgagatcgcatgataaagtgtgaaaaactccggtggtatgagatggacccgcgtctgattagctggttggtggggtaacggcccaccaaggcgacgatcagtagccgacctgagagggtgaccggccacattgggactgagacacggcccaaactcctacgggaggcagcagtggggaatattgcacaatgggggaaaccctgatgcagcaacgccgcgtgagtgaagaagtatttcggtatgtaaagctctatcagcagggaagaaaatgacggtacctgagtaagaagccccggctaactacgtgccagcagccgcggtaatacgtagggggcaagcgttatccggatttactgggtgtaaagggagcgtagacggcgatacaagtctgaagtgaaagcccggggctcaaccccgggactgctttggaaactgtgttgctggagtgctggagaggcaagcggaattcctagtgtagcggtgaaatgcgtagatattaggaagaacaccagtggcgaaggcggcttgctggacagtaactgacgttgaggctcgaaagcgtggggagcaaacaggattagataccctggtagtccacgccgtaaacgatgaatgctaggtgttggggagcaaagcttctcggtgccgccgcaaacgcaataagcattccacctggggagtacgttcgcaagaatgaaactcaaaggaattgacggggacccgcacaagcggtggagcatgtggtttaattcgaagcaacgcgaagaaccttaccaagtcttgacatccctctgacgtaggtagaaatacttattcccttcggggcaggggagacaggtggtgcatggttgtcgtcagctcgtgtcgtgagatgttgggttaagtcccgcaacgagcgcaacccttattcttagtagccagcgagtaaagtcgggcactctagggagactgccagggataacctggaggaaggtggggatgacgtcaaatcatcatgccccttatgatttgggctacacacgtgctacaatggcgtaaacaaagggaggcgaaggagcgatctggagcgaaccccaaaaataacgtctcagttcggattgcaggctgcaacccgcctgcatgaagccggaatcgctagtaatcgcagatcagaatgctgcggtgaatacgttcccgggtcttgtacacaccgcccgtcacaccatgggagtcgataacgcccgaagtcagtgacccaaccgaaaggagggagctgccgaaggcgggatggataactggggtgaagtcgtaacaaggtagccgtatcggaaggtgcggctggatcacctcctttctaaggaa

SEQ ID NO: 10198 - DNA, 1540 bp, bacterium D16-56; identical to SEQ ID NO: 10197
  ref <308>: DATABASE ACCESSION NUMBER: NCBI ACCESSION: NZ_RAYY01000097.1
  ref <309>: DATABASE ENTRY DATE: 2019-04-01
  ref <313>: RELEVANT RESIDUES IN SEQ ID NO: (1)..(1540)

SEQ ID NO: 10199 - DNA, 911 bp, bacterium D16-59
  ref <308>: DATABASE ACCESSION NUMBER: NCBI ACCESSION: NZ_RAYD01000177.1
  ref <309>: DATABASE ENTRY DATE: 2019-04-01
  ref <313>: RELEVANT RESIDUES IN SEQ ID NO: (1)..(911)
acggccacattgggactgagacacggcccaaactcctacgggaggcagcagtggggaatattgcacaatggggggaaccctgatgcagcaacgccgcgtgagtgaagaagtatttcggtatgtaaagctctatcagcagggaagaaaatgacggtacctgactaagaagctccggctaaatacgtgccagcagccgcggtaatacgtatggagcaagcgttatccggatttactgggtgtaaagggagcgcaggcggtgcggcaagtctgatgtgaaagcccggggcccaaccccgggactgcattggaaactgccgcactagagtgccggagaggtaagtggaattcctagtgtagcggtgaaatgcgtagatattaggaggaacaccagtggcgaaggcggcttactggacggtaactgacgctgaggctcgaaagcgtggggagcaaacaggattagataccctggtagtccacgccgtaaacgatgaatactaggtgtcggggcacaacgtgcttcggtgccgcagctaacgcattaagtattccacctggggagtacgttcgcaagaatgaaactcaaaggaattgacggggacccgcacaagcggtggagcatgtggtttaattcgaagcaacgcgaagaaccttaccagcccttgacatcctgctgacagccccgtaacgggggccttcctccgggacagcagagacaggtggtgcatggttgtcgtcagctcgtgtcgtgagatgttgggttaagtcccgcaacgagcgcaacccctattgccagtaaccagcatttcggatggggactctggtgagactgccggggataacccggaggaaggtggggacgacgtcaaatcatcatgccccttatgggctgggctacacacgtgctacaatgg

SEQ ID NO: 10200 - DNA, 1549 bp, bacterium D16-63
  ref <308>: DATABASE ACCESSION NUMBER: NCBI ACCESSION: NZ_RAYX01000065.1
  ref <309>: DATABASE ENTRY DATE: 2019-04-01
  ref <313>: RELEVANT RESIDUES IN SEQ ID NO: (1)..(1549)
atggagagtttgatcctggctcaggacgaacgctggcggcgtgcctaatacatgcaagtcgagcggacggatgggagcttgctcccagaagttagcggcggacgggtgagtaacacgtgggcaacctgccctatagttggggataactccgggaaaccggggctaataccgaatgatataatttagctcctgctagattgttgaaagatggtttacgctatcgctataggatgggcccgcggcgcattagctagttggtgaggtaacggctcaccaaggcgacgatgcgtagccgacctgagagggtgatcggccacactgggactgagacacggcccagactcctacgggaggcagcagtagggaatcttccacaatgggcgaaagcctgatggagcaacgccgcgtgagtgaagaaggttttcggatcgtaaaactctgttgtaagggaagaacaagtacagtagtaactggctgtaccttgacggtaccttattagaaagccacggctaactacgtgccagcagccgcggtaatacgtaggtggcaagcgttgtccggaattattgggcgtaaagcgcgcgcaggcggtcctttaagtctgatgtgaaagccctcggctcaaccgaggagggtcattggaaactggaggacttgagtgcagaagaggaaagtggaattccaagtgtagcggtgaaatgcgtagagatttggaggaacaccagtggcgaaggcgactttctggtctgtaactgacgctgaggcgcgaaagcgtggggagcaaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcccactgaccgctatggagacatagctttcccttcggggacagtggtgacaggtggtgcatggttgtcgtcagctcgtgtcgtgagatgttgggttaagtcccgcaacgagcgcaacccttgtccttagttgccatcattaagttgggcactctaaggagactgccgatgacaaatcggaggaaggtggggatgacgtcaaatcatcatgccccttatgacctgggctacacacgtgctacaatggacggtacaaacggttgcgaagtcgcgagatggagctaatctgataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgaggtaaccttatggagccagccgccgaaggtgggacagatgattggggtgaagtcgtaacaaggtagccgtatcggaaggtgcggctggatcacctcctttct

SEQ ID NO: 10201 - DNA, 1505 bp, bacterium JKG1
  ref <308>: DATABASE ACCESSION NUMBER: NCBI ACCESSION: NZ_JAGA01000002.1
  ref <309>: DATABASE ENTRY DATE: 2019-04-01
  ref <313>: RELEVANT RESIDUES IN SEQ ID NO: (1)..(1505)
ggatgacgagtttgatcctggctcaggatcaacgctggcggcgtgcctaatgcatgcaagtcgagcggccgagcttcggctcggcagcggcgaacggctgaggaacacgtgcgtaacctgccccgcggtgggggataccgggtggaaacacccgctaagaccgcatacgcacgtccggggtgccggacgcggaaagccgagaggcgccgtgggaggggcgcgcggcccatcaggtcgttggtagggtaatggcctaccaagccgatgacgggttgctggtctgagaggacggccagccagactgggactgagacacggcccagacacctacgggtggcagcagcaaggaatcttcggcaatgggcgcaagcctgaccgagcaacgccgcgtggaggacgacggccttcgggttgtaaactccttttcgtggggacgagagggacggtacccacggaagaagccccggctaactctgtgccagcagccgcggtaagacagagggggcaagcgttgtccggatttactgggcgtacagcgcgcgcaggcggcgcgccaggcacccggtgacagtctcccgctcaatgggaggaggtctgggtggaccggcgcgctggaggccgtgagagggtgatggaacgcccggtggagcggtgaaatgcgtagagatcgggcagaacaccagtggggaagccggtcacctggcacggacctgacgctgaggcgcgacagcgtggggagcaaacgggattagataccccggtagtccacgccgtaaacgatgtggagcaggtgtgggggcgtgattgcgcgcctccgtgccgcagcttacgcgttgactccaccgcctgggaactacggccgcaaggctaaaactcaaaggaattgacgggggcccgcacaagcagcggagcgtgtggtttaattcgacgcaacacgaagcacctcacccaggcttgacatgccgctgcagggcgtggaaacacgccggcctctgagggggcggcaccggtgctgcatggctgtcgtcagctcgtgtcgtgagatgttgggttaagtcccgcaacgagcgcaacccctgcccggtgttacgcgtgtcaccggggactgccggccggttcggctggaggaaggcggggatgacgtcaagtcagcatggccctgacgcctggggcgacacacacgctacaatgcgccgtggaatgcgttgcgacctggcaacaggcagcgaatcgccaaggcggcgcgtagtgcggattgggggctgcaactcgcccccatgaaggcggagttgctagtaaccgcgtatcagcatggcgcggtgaatacgtacccgggccttgtacacaccgcccgtcacgtcatgggagtcgggaacacctgaagtccgtgggccaaccggcgcgagccggaggcagcggccgagggtgggcctggcgactgggacgaagtcgtaacaaggtagccgtaccggaaggtgcggctggatcacctcctttctagggag

SEQ ID NO: 10202 - DNA, 1490 bp, bacterium RmlP001
  ref <308>: DATABASE ACCESSION NUMBER: NCBI ACCESSION: NZ_QYBC01000050.1
  ref <309>: DATABASE ENTRY DATE: 2019-04-01
  ref <313>: RELEVANT RESIDUES IN SEQ ID NO: (1)..(1490)
caacttgagagtttgatcctggctcagaacgaacgctggcggcaggcttaacacatgcaagtcgaacgccccgcaaggggagtggcagacgggtgagtaacacgtgggaacatacccttcggttcggaacaacgccgggaaactggcgctaataccggatacggcctgtgggcgaaagattgatcgccgaaggattggcccgcgttcgattagcttgttggtgaggtaacggctcaccaaggcgacgatcgatagctggtctgagaggatggccagccacattgggactgagacacggcccaaactcctacgggaggcagcagtggggaatattggacaatgggcgcaagcctgatccagccatgccgcgtgagtgatgacggccttagggttgtaaagctctttcgcacgcgacgataatgacggtagcgtgagaagaagccccggctaacttcgtgccagcagccgcggtaatacgaagggggctagcgttgttcggaatcactgggcgtaaagggtgcgtaggcgggatcttaagtcaggggtgaaatcccgaggctcaacctcggaactgcctttgatactggggtccttgagtccggaagaggtgagtggaactgcgagtgtagaggtgaaattcgtagatattcgcaagaacaccggtggcgaaggcggctcactggtccggaactgacgctgaggcacgacagcgtggggagcaaacaggattagataccctggtagtccacgccgtaaacgatgaatgccagccgttgggtgatttatcactgagtggcgcagctaacgctttgagcattccgcctggggagtacggtcgcaagattaaaactcaaaggaattgacgggggcccgcacaagcggtggagcatgtggtttaattcgaagcaacgcgcagaaccttaccagcctttgacatggcgggacggtccagagagatttggatcttcacttcggtgacccgcgcacaggtgctgcatggctgtcgtcagctcgtgtcgtgagatgttgggttaagtcccgcaacgagcgcaacccacgtcctcagttgccatcattcagttgggcactctggggagactgccggtgataagccgcgaggaaggtgtggatgacgtcaagtcctcatggcccttacgggctgggctacacacgtgctacaatggcggtgacagagggacgcgagcccgcgagggtcagccaatctcaaaaagccgtctcagttcggattgcactctgcaactcgagtgcatgaagttggaatcgctagtaatcgtggatcagcacgccacggtgaatacgttcccgggccttgtacacaccgcccgtcacaccatgggagttggttctacccgaaggcgtttcgccaacccgcaagggaagcaggcgaccacggtagggtcagcgactggggtgaagtcgtaacaaggtagccgtaggggaacctgcggctggatcacctcctttctaag

SEQ ID NO: 10203 - DNA, 1490 bp, bacterium RmlP026
  ref <308>: DATABASE ACCESSION NUMBER: NCBI ACCESSION: NZ_QYBB01000101.1
  ref <309>: DATABASE ENTRY DATE: 2019-04-01
  ref <313>: RELEVANT RESIDUES IN SEQ ID NO: (1)..(1490)
caacttgagagtttgatcctggctcagaacgaacgctggcggcaggcttaacacatgcaagtcgaacgcccgagcaatcgggagtggcagacgggtgagtaacacgtgggaacatacccttcggttcggaacaacgtttggaaacgaacgctaataccggatacggcttgagggcgaaagattcatcgccgaaggattggcccgcgttcgattagctagatggcggggtaacggcccaccatggcgacgatcgatagctggtctgagaggatggccagccacattgggactgagacacggcccaaactcctacgggaggcagcagtggggaatattggacaatgggcgcaagcctgatccagccatgccgcgtgagtgatgacggccttagggttgtaaagctctttcgcacgcgacgataatgacggtagcgtgagaagaagccccggctaacttcgtgccagcagccgcggtaatacgaagggggctagcgttgttcggaatcactgggcgtaaagggtgcgtaggcggattcttaagtcaggggtgaaatcccgaggctcaacctcggaactgcctttgatactggggatcttgagtccggaagaggtgagtggaactgcgagtgtagaggtgaaattcgtagatattcgcaagaacaccggtggcgaaggcggctcactggtccggaactgacgctgaggcacgacagcgtggggagcaaacaggattagataccctggtagtccacgccgtaaacgatgaatgccagccgttgggtgatttatcactgagtggcgcagctaacgctttgagcattccgcctggggagtacggtcgcaagattaaaactcaaaggaattgacgggggcccgcacaagcggtggagcatgtggtttaattcgaagcaacgcgcagaaccttaccagcctttgacatggcgggacgggcgagagagatttcgtccttcacttcggtgacccgcgcacaggtgctgcatggctgtcgtcagctcgtgtcgtgagatgttgggttaagtcccgcaacgagcgcaacccacgtcctcagttgccatcattcagttgggcactctggggagactgccggtgataagccgcgaggaaggtgtggatgacgtcaagtcctcatggcccttacgggctgggctacacacgtgctacaatggcggtgacagagggaagccaacccgcgagggtgcgccaatctcgaaaagccgtctcagttcggattgcactctgcaactcgagtgcatgaagttggaatcgctagtaatcgtggatcagcacgccacggtgaatacgttcccgggccttgtacacaccgcccgtcacaccatgggagttggttctacccgaaggcgcttcgctgaccgcaagggggcaggcgaccacggtagggtcagcgactggggtgaagtcgtaacaaggtagccgtaggggaacctgcggctggatcacctcctttctaag

SEQ ID NO: 10204 - DNA, 1487 bp, bacterium YEK0313
  ref <308>: DATABASE ACCESSION NUMBER: NCBI ACCESSION: NZ_CCMO02000001.1
  ref <309>: DATABASE ENTRY DATE: 2019-04-01
  ref <313>: RELEVANT RESIDUES IN SEQ ID NO: (1)..(1487)
caacttgagagtttgatcctggctcagaacgaacgctggcggcaggcttaacacatgcaagtcgagcgcctcagcaatggggagcggcagacgggtgagtaacacgtgggaacgtaccttttggttcggaacaactccgggaaactggagctaataccggataagccctaacggggaaagatttatcgccgaaagatcggcccgcgtctgattagctagttggtggggtaatggcccaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttgtccgggaagataatgactgtaccggaagaataagccccggctaacttcgtgccagcagccgcggtaatacgaagggggctagcgttgttcggaatcactgggcgtaaagcgcacgtaggcggaccattaagtcaggggtgaaagcctggagctcaactccagaactgcctttgatactgatggtctcgagttcggaagaggttggtggaactgcgagtgtagaggtgaaattcgtagatattcgcaagaacaccagtggcgaaggcggccaactggtccgatactgacgctgaggtgcgaaagcgtggggagcaaacaggattagataccctggtagtccacgccgtaaacgatgaatgccagccgttggggagcttgctcttcagtggcgcagctaacgctttaagcattccgcctggggagtacggtcgcaagattaaaactcaaaggaattgacgggggcccgcacaagcggtggagcatgtggtttaattcgaagcaacgcgcagaaccttaccagctcttgacatctggtgttacatcgagagatcgatggtcctcttcggaggcgccaagacaggtgctgcatggctgtcgtcagctcgtgtcgtgagatgttgggttaagtcccgcaacgagcgcaaccctcgcctttagttgccagcattcagttgggcactctagagggactgccggtgataagccggaggaaggtggggatgacgtcaagtcctcatggcccttacgggctgggctacacacgtgctacaatggtggtgacagtgggcagcgaagccgcgaggccgagctaatctccaaaagccatctcagttcggattgcactctgcaactcgagtgcatgaagttggaatcgctagtaatcgcagatcagaatgctgcggtgaatacgttcccgggccttgtacacaccgcccgtcacaccatgggagttgggtttacccgaaggcagtgcgctaaccgcaagggggcagctgaccacggtaggctcagcgactggggtgaagtcgtaacaaggtagccgtaggggaacctgcggctggatcacctcctttctaag

SEQ ID NO: 10205 - DNA, 1541 bp, beta proteobacterium FWI2
  ref <308>: DATABASE ACCESSION NUMBER: NCBI ACCESSION: NZ_AMZA01000425.1
  ref <309>: DATABASE ENTRY DATE: 2019-04-01
  ref <313>: RELEVANT RESIDUES IN SEQ ID NO: (1)..(1541)
agattgaactgaagagtttgatcctggctcagattgaacgctggcggcatgccttacacatgcaagtcgaacggcagcgcggacttcggtctggcggcgagtggcgaacgggtgagtaatacatcggaacgtaccctgttgtgggggataactagtcgaaagattagctaataccgcatacgacctgagggtgaaagtgggggaccgcaaggcctcacgcagcaggagcggccgatgtctgattagctagttggtggggtaaaggcccaccaaggcgacgatcagtagctggtctgagaggacgatcagccacactgggactgagacacggcccagactcctacgggaggcagcagtggggaattttggacaatgggggcaaccctgatccagcaatgccgcgtgtgtgaagaaggccttcgggttgtaaagcacttttgtccggaaagaaatcgcgctggttaatacctggcgtggatgacggtaccggaagaataagcaccggctaactacgtgccagcagccgcggtaatacgtagggtgcgagcgttaatcggaattactgggcgtaaagcgtgcgcaggcggttttgtaagacaggcgtgaaatccccgggcttaacctgggaattgcgcttgtgactgcaaggctagagtgcgtcagaggggggtagaattccacgtgtagcagtgaaatgcgtagagatgtggaggaataccgatggcgaaggcagccccctgggacgtgactgacgctcatgcacgaaagcgtggggagcaaacaggattagataccctggtagtccacgccctaaacgatgtcaactagttgttggggattcattttctcagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgccactaacgaagcagagatgcattaggtgcccgaaagggaaagtggacacaggtgctgcatggctgtcgtcagctcgtgtcgtgagatgttgggttaagtcccgcaacgagcgcaacccttgtctctagttgctacgcaagagcactctagagagactgccggtgacaaaccggaggaaggtggggatgacgtcaagtcctcatggcccttatgggtagggcttcacacgtcatacaatggtgcgtacagagggttgccaacccgcgagggggagctaatcccagaaaacgcatcgtagtccggatcgtagtctgcaactcgactacgtgaagctggaatcgctagtaatcgcggatcagcatgccgcggtgaatacgttcccgggtcttgtacacaccgcccgtcacaccatgggagtgggttttgccagaagtagttagcctaaccgcaaggagggcgattaccacggcagggttcatgactggggtgaagtcgtaacaaggtagccgtatcggaaggtgcggctggatcacctcctttctag

SEQ ID NO: 10206 - DNA, 1494 bp, cyanobacterium PCC 7702
  misc_feature (171)..(171): n is a, c, g, or t
  misc_feature (220)..(220): n is a, c, g, or t
  ref <308>: DATABASE ACCESSION NUMBER: NCBI ACCESSION: NZ_KB235926.1
  ref <309>: DATABASE ENTRY DATE: 2019-04-01
  ref <313>: RELEVANT RESIDUES IN SEQ ID NO: (1)..(1494)
acggagagtttgatcctggctcaggatgaacgctggcggtatgcataacacatgcaagtcgaacggtctggaaacagacagtggcggacgggtgagtaacgcgtgagaatctaacttgtggttcgggataaccactggaaacggtggctaagaccggatgtgccgggaggngaaagggagaccgccacaagaggagctcgcgtccgattagctagatggnggggtaaaggcctaccatggcgacgatcggtagctggtctgagaggacgaacagccacactgggactgagacacggcccagactcctacgggaggcagcagtggggaattttccgcaatgggcgaaagcctgacggagcaataccgcgtgagggaggaaggcccttgggttgtaaacctcttttctcagggaagaagaaatgacggtacctgaggaaaaagcatcggctaactccgtgccagcagccgcggtaatacggaggatgcaagcgttatccggaatgattgggcgtaaagggtccgtaggtggtgatgtatgtctattgtcaaaggttctggcttaaccagagacaggcagtagaaactgcaaaactagagtgcagtcggggcagggggaattcctggtgtagcggtgaaatgcgtagagttcaggaagaacaccggtggcgaaagcgccctgctaggctgtgactgacactgagggacgaaagctaggggagcgaatgggattagataccccagtagtcctagccgtaaacgatggatactaggcgttgcgtgtatcgacccatgcagtgccgtagctaacgcgttaagtatcccgcctggggagtacgcacgcaagtgtgaaactcaaaggaattgacgggggcccgcacaagcggtggagtatgtggtttaattcgatgcaacgcgaagaaccttaccagggcttgacatgtccggaatcttgtggaaacacaagagtgcctgcgggaaccggaacacaggtggtgcatggctgtcgtcagctcgtgtcgtgagatgttgggttaagtcccgcaacgagcgcaaccctcgttctgagttgccagcaagaaagatgggcactctcagaagactgccggtgacaaaccggaggaaggtggggatgacgtcaagtcagcatgcccctgacgtcctgggctacacacgtactacaatgctttcgacaaagggcagcgagactgcgaagtcaagcaaatcccagaaacgaaggctcagttcagatcgcaggctgcaactcgcctgcgtgaaggaggaatcgctagtaattgcaggtcagcatactgcagtgaatccgttcccgggccttgtacacaccgcccgtcacaccatggaagctggtcatgcccgaagtcgttacccaaactgggaacagaaggggacgccgaaggcaggactggtgactggggtgaagtcgtaacaaggtagccgtaccggaaggtgtggctggatcacctcctttttagggag

SEQ ID NO: 10207 - DNA, 1485 bp, cyanobacterium endosymbiont of Epithemia turgida
  ref <308>: DATABASE ACCESSION NUMBER: NCBI ACCESSION: NZ_AP012549.1
  ref <309>: DATABASE ENTRY DATE: 2019-04-01
  ref <313>: RELEVANT RESIDUES IN SEQ ID NO: (1)..(1485)
tatggagagtttgatcctggctcaggatgaacgctggcggtatgcctaacacatgcaagtcgaacgagctcttcggagctagtggcggacgggtgagtaacgcgtgagaatctacctcttggttggggataacatttggaaacgactgctaatacccaatgtgccgtaaggtaaaagatttattgccaggagaagagctcgcgtctgattagctagttggtggggtaagagctcaccaaggcatcgatcagtagctggtctgagaggatgaacagccacactgggactgagacacggcccagactcctacgggaggcagcagtggggaattttccgcaatgggcgaaagcctgacggagcaataccgcgtgagggaggaaggctcttgggttgtaaacctcttttctcagggaagaagatatgacggtacctgaggaataagcatcggctaactccgtgccagcagccgcggtaatacggaggatgcaagcgttatccggaattattgggcgtaaagcgtccgcaggtggtcactcaagtctgctgttaaatactagagcttaactctggaaaggcagtggaaactgagaaactagagtccggtaggggtagcgggaattcccagtgtagcggtgaaatgcgtagatattgggaagaacatcggtggcgaaagcgcgctactgggccggaactgacactcagggacgaaagctaggggagcgaaagggattagatacccctgtagtcctagccgtaaacgatggaaactaggtgtggcttgtatcgacccaagccgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtcgcgaaccttaatgaaagttgagggtgccttcgggagcgcgaacacaggtggtgcatggctgtcgtcagctcgtgtcgtgagatgttgggttaagtcccgcaacgagcgcaaccctcgttcttagttgccatcattaagttgggaactctagggagactgccggtgacaaaccggaggaaggtgaggacgacgtcaagtcagcatgccccttacgctctgggcgacacacgtactacaatggttgggacaaagggcagcgaccccgcgagggaaagcgaatctcatcaaacccagcctcagttcagattgcaggctgcaactcgcctgcatgaaggaggaatcgctagtaatcgcaggtcagcatactgcggtgaattcgttcccgggccttgtacacaccgcccgtcacaccatggaagctggtcacgcccaaagtagttaccctaaccttttggagggggactcctaaggcagggctggtgactggggtgaagtcgtaacaaggtagccgtaccggaaggtgtggctggatcacctcctta

SEQ ID NO: 10208 - DNA, 1484 bp, cyanobacterium endosymbiont of Rhopalodia gibberula
  ref <308>: DATABASE ACCESSION NUMBER: NCBI ACCESSION: NZ_AP018341.1
  ref <309>: DATABASE ENTRY DATE: 2019-04-01
  ref <313>: RELEVANT RESIDUES IN SEQ ID NO: (1)..(1484)
atggagagtttgatcctggctcaggatgaacgctggcggtatgcctaacacatgcaagtcgaacgggctcttcggagctagtggcggacgggtgagtaacgcgtgagaatctacctcttggttggggacaacagttggaaacgactgctaatacccaatgtgccgtaaggtgaaagatttattgccaggagaagagctcgcgtctgattagctagttggtgaggtaagagctcaccaaggcgtcgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaagatctgacggtacctgaggaataagcatcggctaactccgtgccagcagccgcggtaatacggaggatgcaagcgttatccggaattattgggcgtaaagcgtccgcaggtggttactcaagtctgctgttaaagatcagagcttaactctggaaaggcagtggaaactgagaaactagagtccggtaggggtagcgggaattcccagtgtagcggtgaaatgcgtagatattgggaagaacatcggtggcgaaagcgcgctactgggccggaactgacactcagggacgaaagctaggggagcgaaagggattagatacccctgtagtcctagctgtaaacgatggaaactaggtgtggcttgtatcgacccgagccgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtcgcgaaccttgatgaaagtcgagggtgccttcgggaacgcgaacacaggtggtgcatggctgtcgtcagctcgtgtcgtgagatgttgggttaagtcccgcaacgagcgcaaccctcgtccttagttgccatcattaagttgggaactctagggagaccgccggtgacaaaccggaggaaggtgaggacgacgtcaagtcagcatgccccttacgctctgggcgacacacgtactacaatggttgggacaaagggcagcgaccccgcgagggaaagcgaatctcatcaaacccagcctcagttcagattgcaggctgcaactcgcctgcatgaaggaggaatcgctagtaatcgcaggtcagcatactgcggtgaattcgttcccgggccttgtacacaccgcccgtcacaccatggaagctggtcacgcccgaagtagttaccctaaccttttggagggggactcctaaggcagggctggtgactggggtgaagtcgtaacaaggtagccgtaccggaaggtgtggctggatcacctcctta

SEQ ID NO: 10209 - DNA, 1568 bp, delta proteobacterium MLMS-1
  ref <308>: DATABASE ACCESSION NUMBER: NCBI ACCESSION: NZ_AAQF01000123.1
  ref <309>: DATABASE ENTRY DATE: 2019-04-01
  ref <313>: RELEVANT RESIDUES IN SEQ ID NO: (1)..(1568)
atcaaactggagagtttgatcctggctcagattgaacgctggcggcgtgcttaacacatgcaagtcgaacgagaaagggtcttcggacctgagtagagtggcgcacgggtgagtaacgcgtaagtaacctgcccctgtatttgggataacagtgcgaaagtgctgctaataccgaataatctcaatggccgcgtggtaattgaggaaaggtgacctcttcatgaaagttaccgtagagggaggggcttgcgtaccattagctggttggtggggtaatggcctaccaaggcgacgatggttagcgggtttgagaggatgatccgccacactggaactgaaacacggaccagactcctacgggaggcagcagtgaggaatattgcgcaatgggggcaaccctgacgcagcgacgccgcgtgagtgaagaaggccttagggttgtaaagctctgtcagaagggaagaagtgtgtagcggttaatacccgttacatttgacggtaccttcaaaggaagcaccggctaactccgtgccagcagccgcggtaatacggagggtgcgagcgttaatcggaattactgggcgtaaagggcgcgtaggcggccgatcaagtcaggtgtgaaagcccacggctcaaccgtggaggtgcatttgaaactggttggcttgagtatcggaaggggagatggaattcccggtgtagaggtgaaattcgtagatatcgggaggaataccggtggcgaaggcgatcttctggacgaatactgacgctgaggcgcgaaagcgtgggtagcaaacaggattagataccctggtagtccacagctgtaaacgatgtgcactagatgtaggggggaattgaccccctctgtgtcgcagctaacgcattaagtgcaccgcctggggagtacggccgcaaggttaaaactcaaaggaattgacgggggcccgcacaagcggtggagtatgtggtttaattcgacgcaacgcgcagaaccttacctgggcttgacatcccggagatctttgggaaaccagagagtgctttcattaggaagaatccggtgacaggtgctgcatggctgtcgtcagctcgtgtcgtgagatgttgggttaagtcccgcaacgagcgcaacccttgcctttagttgccatcattaagttgggcactctagagggactgccggtgtcaaaccggaggaaggtggggatgacgtcaagtcctcatggcctttatgtccagggctacacacgtactacaatggccggtacagagggcagcgacttggtgacaagtagcgaatctcaaaaagccggtctcagtccggattggagtctgcaactcgcctccatgaagttggaatcgctagtaatcgcggatcagcatgccgcggtgaatacgttcccgggccttgtacacaccgcccgtcacaccacgaaagtcggttgttccagaagcggttgggctaacccgcaagggaggcaggctgccaaggaatgattggtaattggggtgaagtcgtaacaaggtagccgtaggggaacctgcggctggatcacctcctttta

SEQ ID NO: 10210 - DNA, 1449 bp, delta proteobacterium NaphS2
  ref <308>: DATABASE ACCESSION NUMBER: NCBI ACCESSION: NZ_ADZZ01000059.1
  ref <309>: DATABASE ENTRY DATE: 2019-04-01
  ref <313>: RELEVANT RESIDUES IN SEQ ID NO: (1)..(1449)
tttaagtggagagtttgatcctggctcagaacaaacgctggcggcgtgcttaacacatgcaagtcgaacgagaaattccctgcttgcagggaagagtaaagtggcgcacgggtgagtaacgcgtgggtaacctacctttgaattcggaatagcccgtcgaaaggtggattaataccggatacggtttaaggatcttcggatttttaaattaaaggtgacctcttcatgaaagttgccgttcatagatgggcccgcgtaccattagcttgttggtggggtaatggcctaccaaggcgacgatggttagctggtctgagaggatgatcagccacactggaactggaacacggtccagactcctacgggaggcagcagtgaggaattttgcgcaatgggggaaaccctgacgcagcaacgccgcgtgagcgaagaaggccttcgggtcgtaaagctctgtcaagtgggaaaaaaatcttttgatgaatagttaaaagacttgatggtaccactggaggaagcaccggctaactccgtgccagcagccgcggtaatacggagggtgcaagcgttgttcggaattactgggcgtaaagagcgtgtaggcggtttgacaagtcagatgtgaaagccccgagctcaacccgggaagtgcatttgaaactgtctcactagagtatgggagaggagattggaattcctggtgtagaggtgaaattcgtagatatcaggaggaacacccgtggcgaaggcgattctctggaccaatactgacgctgagacgcgaaagcgtggggagcaaacaggattagataccctggtagtccacgccgtaaacgatgagaactaggtgtagtgggtattgacccctgctgtgccgaagttaacgcattaagttctccgcctggggagtacggccgcaaggctaaaactcaaaggaattgacgggggcccgcacaagcggtggagcatgtggtttaattcgacgcaacgcgaagaaccttacctgggtttgacatcctttgaccgtctgtgaaagcagatttttccggctttgccggaacagagtgacaggtgctgcatggctgtcgtcagctcgtgtcgtgagatgttgggttaagtcccgcaacgagcgtaacccttgtctttagttgccattattaagttaggcactctaaagagactgcctcggttaacggggaggaaggtggggatgacgtcaagtcctcatggcctttatatccagggctacacacgtgctacaatgggctgtacaaagggttgctatcccgcgagggggcgctaatcccaaaaagcagttctcagttcggattgaagtctgcaactcgacttcatgaaggtggaatcgctagtaatcgtggatcagcatgccacggtgaatacgttcccgggccttgtacacaccgcccgtcacaccacgaaagtcgactg

SEQ ID NO: 10211 - DNA, 354 bp, filamentous cyanobacterium CCP2
  ref <308>: DATABASE ACCESSION NUMBER: NCBI ACCESSION: NZ_PVWD01000092.1
  ref <309>: DATABASE ENTRY DATE: 2019-04-01
  ref <313>: RELEVANT RESIDUES IN SEQ ID NO: (1)..(354)
aacatggagagtttgatcctggctcaggatgaacgctggcggtctgcttaacacatgcaagtcgaacggagtgcttcggcacttagtggcggacgggtgagtaacgcgtgagaatctgcccttaggagggggataacgactggaaacggtcgctaataccccatatgccgagaggtgaaaagttttatcgcctgaggatgagctcgcgtctgattagctagttggtagggtaagagcctaccaaggcgacgatcagtagctggtctgagaggatgaccagccacactgggactgagacacggcccagactcctacgggaggcagcagtggggaattttccgcaatgggcgaaag

SEQ ID NO: 10212 - DNA, 537 bp, filamentous cyanobacterium CCP4
  ref <308>: DATABASE ACCESSION NUMBER: NCBI ACCESSION: NZ_PYFY01000353.1
  ref <309>: DATABASE ENTRY DATE: 2019-04-01
  ref <313>: RELEVANT RESIDUES IN SEQ ID NO: (1)..(537)
ggctgcatggggtagagatacccctttcttcggaccgcctgcaaggtgctgcatggttgtcgttagctcgtgccgtgaggtgtcaggttaagtcctataacgagcgcaacccctaccgttagttgccagcatgtcaagatggggactctaacgggactgccggtgcaaaccgtgaggaaggtggggacgacgtcaaatcatcacggcccttacgtcctgggctacacacgtgctacaatggccggtacagagggaagccaccccgcaagggggcgcggatctacaaaaccggtcacagttcggatcggggtctgcaactcgaccccgtgaagctggaatcgctagtaatcggatatcagccatgatccggtgaatacgttcccgggccttgtacacaccgcccgtcaagccatggaagccgggagtgcctgaagtccgtcaccgcaaggagcggcctagggcaaaatcggtaactagggctaagtcgtaacaaggtagccgtaccggaaggtgcggctggaacacctcctttctaga

SEQ ID NO: 10213 - DNA, 1513 bp, filamentous cyanobacterium CCP5
  ref <308>: DATABASE ACCESSION NUMBER: NCBI ACCESSION: NZ_PYEQ01000417.1
  ref <309>: DATABASE ENTRY DATE: 2019-04-01
  ref <313>: RELEVANT RESIDUES IN SEQ ID NO: (1)..(1513)
tggagagtttgatcctggctcaggatgaacgctagcggcaggcctaatacatgcaagtcgaacggtagactactttcgggtagttgagagtggcgcacgggtgcgtaacgcgtatgcaacctaccttgtacagggggatagcccggagaaattcggattaataccccatagcattatcagatggcatctgaagataattaaagatttatcggtacaagatgggcatgcgtgacattagttagttggtagggtaaaggcctaccaagacgatgatgtctaggggttctgagaggatgatcccccacactggtactgagatacggaccagactcctacgggaggcagcagtagggaatattggtcaatgggcgagagcctgaaccagccatgccgcgtgcaggaagacggccttctgggttgtaaactgcttttctacgggaagaaaatgcccttgcgagggaaattgccggtaccgtaggaataagcaccggctaactccgtgccagcagccgcggtaatacggagggtgcaagcgttgtccggatttattgggtttaaagggtgcgtaggcggatctttaagtcagtggtgaaagcctgcagcttaactgtagaattgccattgatactggaggtcttgagtgtactagaggtaggcggaatttatggtgtagcggtgaaatgcatagataccataaagaacaccgatagcgtaggcagcttactggagtacaactgacgctgaggcacgaaagcatggggagcgaacaggattagataccctggtagtccatgccgtaaacgatgattactcgatgttggcgatatacagtcagcgtccaagcgaaagcgttaagtaatccacctggggagtacgctcgcaagagtgaaactcaaaggaattgacgggggtccgcacaagcggtggagcatgtggtttaattcgatgatacgcgaggaaccttacctgggctagaatgcgagtgaatcattcagaaatggatgagtcttcggacacgaagcaaggtgctgcatggctgtcgtcagctcgtgccgtgaggtgttgggttaagtcccgcaacgagcgcaacccctactgttagttgccagcatgtaatgatggggactctaacaggactgcctgcgcaagcagagaggaaggaggggacgacgtcaagtcatcatggcccttacgcccagggctacacacgtgctacaatggggggtacagagggttgctacacggtaacgtgatgccaatctcaaaaagcccttctcagttcggatcgtggtctgcaactcgaccacgtgaaggtggaatcgctagtaatcgcgcatcagcaatggcgcggtgaatacgttcccggaccttgtacacaccgcccgtcaagccatgggagttgggtggacctgaagatggttgctgtaaggcgctatttagggtaaaaccagcgactggggctaagtcgtaacaaggtagccgtaccggaaggtgtggctggaacacctccttt

SEQ ID NO: 10214 - DNA, 1559 bp, filamentous cyanobacterium CCT1
  ref <308>: DATABASE ACCESSION NUMBER: NCBI ACCESSION: NZ_PYER01000528.1
  ref <309>: DATABASE ENTRY DATE: 2019-04-01
  ref <313>: RELEVANT RESIDUES IN SEQ ID NO: (1)..(1559)
aagtgaagggtttgatcctggctcagaacgaacgttggcggcgtggatgaggcatgcaagtcgaacgtgaaagccttcgggcgagtagcgtggcggacgggtgagtaacacgtaatcaagctacctgccagacggggataactccgggaaaccggggctaatacccgatggtctcacgtgaccgcatggtgatgtgagtaaatgctcgggatcctccgggatcgtgtgctggcagaggtgattgcggcccatcagctagttggtagggtaatggcctaccaaggctgcgacgggtagccggcctaagagggtggtcggtcacactgggactgagacactgcccagactcctacgggaggctgcagtcgagaatcttccgcaatgggcgaaagcctgacggagcgacgccgcgtggaggacgaaggccttcgggttgtaaactcctgtcacgagttaagaagggcgtatggtgaacagccgtgcgtcttgacgtaagctcgagaggaagcactggctaactctgtgccagcagccgcggtaatacagagagtgcgaacgttgttcggaattactgggcttaaagcgtacgtaggcggcgcagcaagtgtcgggtgaaatcccacggctcacccgtggaattgcccggcaaactgctgtgctcgagtgtggtaggggagagcggaactcctggtggagcggtgaaatgcgtagatatcaggaggaacaccggtggcgaaggcggctctctggtccacaactgacgctgaggtacgaaagctagggtagcgaacgggattagataccccggtagtcctagccgtaaacgatgggcactagcttggggactccctgtgtgtttccaggtgaagcaaaagtgataagtgccccgcctggggagtatggtcgcaaggctgaaactcaaaggaattgacgggggctcacacaagcggtggagcatgtggtttaattcgaagcaacgcgaagaaccttacccaggcttgacatgcaggggctaggccggtgaaagtcggctgattaccttcgggtgtgacctgcacaggtgttgcatggctgtcgtcagctcgtgtcgtgagatgtcgggttaagtcccttaacgagcgaaacccttatcactagttaccagcgggtaaagccgggcactttagtgagactgccgttgtcaaaacggaggaaggtggggacgacgtcaagtcatcatggcccttacgcctggggctacacacgtgctacaatggctggtacagagagatgcgaagccgcgaggtagtgcagacctcataaagccagccccagttcggattgcaggctgcaactcgcctgcatgaagttggaatcgctagtaatcgcggatcagctacgccgcggtgaatatgttcctgagccttgtacacaccgcccgtcaagccacgaaagctgagagcgcccgaagtcgctagtccaaccgcaaggagggcggcgccgaaggcgagcttggtgattgggactaagtcgtaacaaggtagccgtaggggaacctgcggctggatcacctcctttta

SEQ ID NO: 10215 - DNA, 1493 bp, filamentous cyanobacterium ESFC-1
  ref <308>: DATABASE ACCESSION NUMBER: NCBI ACCESSION: NZ_KB904821.1
  ref <309>: DATABASE ENTRY DATE: 2019-04-01
  ref <313>: RELEVANT RESIDUES IN SEQ ID NO: (1)..(1493)
aatggagagtttgatcctggctcaggatgaacgctggcggtctgcttaacacatgcaagtcgaacgaagtcttcggacttagtggcggacgggtgagtaacacgtgagaatctgccctcaagacggggacaacagttggaaacgactgctaatccccgatgagcccaagggtgaaaagaaattcgcttgaggaggagctcgcgtccgattagcttgttggtgaggtaaaggctcaccaaggccacgatcggtagccggtctgagaggacgatcggccacactgggactgagacacggcccagactcctacgggaggcagcagtggggaattttccgcaatgggcgaaagcctgacggagcaagaccgcgtgtgggaggaaggccttctgggtcgtaaaccacttttctcagggaagaagctctgacggtacctgaggaatcagcctcggctaactccgtgccagcagccgcggtaatacggaggaggcaagcgttatccggaattattgggcgtaaagcgtccgcaggtggcttttcaagtctgctgtcaaagcccgaagctcaacttcggagaggcagtggaaactgggaagctagagaacggtaggggtagagggaattcccagtgtagcggtgaaatgcgtagagattgggaagaacaccggtggcgaaagcgctctactgggccgtatctgacactcagggacgaaagctagggtagcgaatgggattagataccccagtagtcctagctgtaaacgatggaaactaggcgtggcttgtatcgacccgagccgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatctcggtgagagctgagagtgccttcgggaacgcgaacacaggtggtgcatggctgtcgtcagctcgtgtcgtgagatgttgggttaagtcccgcaacgagcgcaaccctcgtccttagttgccagcattaagttgggcactctagggagactgccggtgacaaaccggaggaaggtggggatgacgtcaagtcagcatgccccttacgccctgggctacacacgtactacaatggtcgagacaaagggcagcaactccgcaaggacaagcgaatctcatcaaactcggcctcagttcagattgccggctgcaactcgccggcatgaaggaggaatcgctagtaatcgcaggtcagcatactgcggtgaatccgttcccgggccttgtacacaccgcccgtcacaccatggaagctggccacgcccgaagtcgttaccctaaccgttcgcggagggggacgccgaaggcagggctagtgactggggtgaagtcgtaacaaggtagccgtaccggaaggtgtggctggatcacctccttttaagg

SEQ ID NO: 10216 - DNA, 1539 bp, gamma proteobacterium BDW918
  ref <308>: DATABASE ACCESSION NUMBER: NCBI ACCESSION: NZ_JH650812.1
  ref <309>: DATABASE ENTRY DATE: 2019-04-01
  ref <313>: RELEVANT RESIDUES IN SEQ ID NO: (1)..(1539)
taaactgaagagtttgatcatggctcagattgaacgctggcggcaggcctaacacatgcaagtcgagcggtagaggatagcttgctatccaaagcagcggcggacgggtgagtaacgcgtgggaatctacctagtagagggggacaactcggggaaactcgagctaataccgcatacgccctacgggggaaaggaggggatcttcggaccttccgctattagatgagcccgcgttagattagctagttggtagggtaaaggcctaccaaggcgacgatctatagctggtctgagaggatgatcagccacactgggactgagacacggcccagactcctacgggaggcagcagtggggaatattgcgcaatggacgaaagtctgacgcagccatgccgcgtgtgtgaagaaggccttagggttgtaaagcactttcaatggggaggaaaggttgcaggctaataccttgtaactgtgacgttacccatacaagaagcaccggctaactccgtgccagcagccgcggtaatacggagggtgcaagcgttaatcggaattactgggcgtaaagcgcgcgtaggcggatttgtcagtcagatgtgaaagccctgggctcaacctaggaattgcatttgatactgcaggtctagagtatggtagaggtgagtggaattccaggtgtagcggtgaaatgcgtagatatctggaggaacatcagtggcgaaggcgactcactggatcaatactgacgctgaggtgcgaaagcgtggggagcaaacaggattagataccctggtagtccacgccgtaaacgatgtctactagccgttggggaacttgattccttagtggcgcagctaacgcactaagtagaccgcctggggagtacggccgcaaggttaaaactcaaatgaattgacgggggcccgcacaagcggtggagcatgtggtttaattcgatgcaacgcgaagaaccttaccaggtcttgacatcccgagaagtcgctagagatagcttcgtgccttcgggaactcggtgacaggtgctgcatggctgtcgtcagctcgtgtcgtgagatgttgggttaagtcccgtaacgagcgcaacccttgtcctttgttgccagcacgtaatggtgggaactcaaaggagactgccggtgacaaaccggaggaaggtggggacgacgtcaagtcatcatggcccttacgacctgggctacacacgtgctacaatgggcagtacagagggtcgcgaagccgcgaggtggagccaatcccttaaaactgttcgtagtccggattggagtctgcaactcgactccatgaagtcggaatcgctagtaatcgcgaatcagaatgtcgcggtgaatacgttcccgggccttgtacacaccgcccgtcacaccatgggagtggattgcaccagaagtggttagcctaaccgtaaggggggcgatcaccacggtgtggttcatgactggggtgaagtcgtaacaaggtagccctaggggaacctggggctggatcacctccttaa

SEQ ID NO: 10217 - DNA, 1551 bp, gamma proteobacterium WG36
  ref <308>: DATABASE ACCESSION NUMBER: NCBI ACCESSION: NZ_AMYV01000236.1
  ref <309>: DATABASE ENTRY DATE: 2019-04-01
  ref <313>: RELEVANT RESIDUES IN SEQ ID NO: (1)..(1551)
tttaattgaagagtttgatcatggctcagattgaacgctggcggcaggcctaacacatgcaagtcgagcggtagcacgggagagcttgctctctgggtgacgagcggcggacgggtgagtaatgtctgggaaactgcctgatggagggggataactactggaaacggtagctaataccgcatgatgtcgcaagaccaaagtgggggaccttcgggcctcacgccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttagggttgtaaagcactttcagcgaggaggaaggcgttgtagttaatagctgcaacgattgacgttactcgcagaagaagcaccggctaactccgtgccagcagccgcggtaatacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgctgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaatttgctagagatagcttagtgccttcgggaactctgagacaggtgctgcatggctgtcgtcagctcgtgttgtgaaatgttgggttaagtcccgcaacgagcgcaacccttatcctttgttgccagcacgtaatggtgggaactcaaaggagactgccggtgataaaccggaggaaggtggggatgacgtcaagtcatcatggcccttacgagtagggctacacacgtgctacaatggcgtatacaaagagaagcgaactcgcgagagcaagcggacctcataaagtacgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttacctcaa

SEQ ID NO: 10218 - DNA, 1540 bp, marine gamma proteobacterium HTCC2148
  ref <308>: DATABASE ACCESSION NUMBER: NCBI ACCESSION: NZ_DS999225.1
  ref <309>: DATABASE ENTRY DATE: 2019-04-01
  ref <313>: RELEVANT RESIDUES IN SEQ ID NO: (1)..(1540)
taaactgaagagtttgatcatggctcagattgaacgctggcggcaggcctaacacatgcaagtcgagcgagaaagtacttcggtacgagtaaagcggcggacgggtgagtaacgcgtaggaatctacctggtagtgggggacaacatgtggaaacgcatgctaataccgcatacgacctaagggtgaaagtgggggaccttcgggcctcacgctatcggatgagcctgcgtaagattagctagttggtgaggtaagagctcaccaaggcgacgatctttagctggtctgagaggatgatcagccacactgggactgagacacggcccagactcctacgggaggcagcagtggggaatattgcgcaatggaggaaactctgacgcagccatgccgcgtgtgtgaagaaggccttagggttgtaaagcactttcaattgggaagaaaggttgtacgttaatagcgtgcagctgtgacattacctttagaagaagcaccggctaactccgtgccagcagccgcggtaatacggagggtgcgagcgttaatcggaattactgggcgtaaagcgcgcgtaggcggtttgttaagtcggatgtgaaagccctgggctcaacctgggaactgcattcgatactggcaaactagagtgcgagagagggaggtagaattccatgtgtagcggtgaaatgcgtagatatgtggaggaataccggtggcgaaggcggcctcctggctcgacactgacgctgaggtgcgaaagcgtggggagcaaacaggattagataccctggtagtccacgccgtaaacgatgtctactagccgttgggaaacttgatttcttagtggcgcagctaacgcactaagtagaccgcctggggagtacggccgcaaggttaaaactcaaatgaattgacgggggcccgcacaagcggtggagcatgtggtttaattcgatgcaacgcgaagaaccttaccaggtcttgacatacagcgaactttccagagatggattggtgccttcgggagcgctgatacaggtgctgcatggctgtcgtcagctcgtgtcgtgagatgttgggttaagtcccgtaacgagcgcaacccttgtccttagttgccagcacgtaatggtgggaactctagggagactgccggtgacaaaccggaggaaggtggggacgacgtcaagtcatcatggcccttacgacctgggctacacacgtgctacaatggaacgcacagagggcagcaaacccgcgagggggagcgaatcccacaaaacgtttcgtagtccggatcggagtctgcaactcgactccgtgaagtcggaatcgctagtaatcgtgaatcagaatgtcacggtgaatacgttcccgggccttgtacacaccgcccgtcacaccatgggagtgggttgctccagaagtggctagcttaaccttcgggagagcggtcaccacggagtgattcatgactggggtgaagtcgtaacaaggtagccctaggggaacctggggctggatcacctccttaaacga

SEQ ID NO: 10219 - DNA, 1518 bp, uncultured Termite group 1 bacterium
  ref <308>: DATABASE ACCESSION NUMBER: NCBI ACCESSION: NC_020419.1
  ref <309>: DATABASE ENTRY DATE: 2019-04-01
  ref <313>: RELEVANT RESIDUES IN SEQ ID NO: (1)..(1518)
tggagagtttgatcctggctcagagtgaacgctagcggcgtgcctaacacatgcaagttgtgcgggattctgcagagtatcgcagagtttagcggcaaacgggtgagtaacacgtaggaaacctccctcagaatggggaatatttccgagaaatcggagccaataccgcataagaccacagtttggcatcaaatagtggttaaagcagcaatgcgttttgagatggtcctgcgtcctatcagctagttggcagggtaacggcccgccaaggctatgacgggtatccgtccttaaagggtgaacggacacactggaactgagacacggtccagactcctatgggaggcagcagtggggaattttggacaatgggggaaaccctgatccagcgacgccgcgtggaggatgaaggccttcgggttgtaaactccttttagaggggaagaaataaatgacattaccctcagaaaaagccacggctaactacgtgccagcagccgcggtaatacgtaggtggcgagcgttactcggaattactaggcgtaaagcgtatgtaggctgtcgtataagtctttagtaaaatttcccggctcaaccgagaaaagcctaatggatactgttcgacttgagtgtgggagagggagacggaattcctggtgtagcggtgaaatgcgtagatatcaggaggaacaccgatggcgaaagcagtctcctggaccaatactgacgctgatgtacgaaagctagggtagcaaacaggattagataccctggtagtcctagctgtaaactatgttcactagatgtgggaggtatcgaccccttccgcgtcgacgttaacgcattaagtgaaccgcctggggagtacggccgcaaggttgaaactcaaaggaattgacgggggcccgcacaagcggtggagtatgtggtttaattcgacgcaacgcgaagaaccttacctgggcttgaactgctgatggtaaaaaccggaaacggtgatgacccgcaagggagtcagcagaggtgttgcatggctgtcgtcagctcgtgtcgtgagatgttgggttaagtcccgcaacgagcgcaacccttatcccatgttacctgtagcgatacggggtctctgaggaaactgccattgataaaatggaggaaggtgaggacgacgtcaagtcatcatgtcctttatgtccagggctacacacgtactacaatggccggtacagagggcagcaatatcgtgaggtggagcaaatccctgaaagccggccccagttcagattgtgggctgcaattcgtccacatgaagtaggaatcgctagtaatcgcagatcagcaggctgcggtgaatacgttcccgggccttgtacacaccgcccgtcacaccacgaaagtcagtcataacagaagtcgtcgggctaaccgaaaggaggcagtcgcctaagttatggttggtgattggggtgaagtcgtaacaaggtagccgtacgagaacgtgcggctggatcacctcctttt

SEQ ID NO: 10220 - DNA, 1485 bp, unicellular cyanobacterium SU2
  ref <308>: DATABASE ACCESSION NUMBER: NCBI ACCESSION: NZ_NEED01000041.1
  ref <309>: DATABASE ENTRY DATE: 2019-04-01
  ref <313>: RELEVANT RESIDUES IN SEQ ID NO: (1)..(1485)
tatggagagtttgatcctggctcaggatgaacgctggcggtatgcctaacacatgcaagtcgaacgggcttttcggagctagtggcggacgggtgagtaacgcgtgagaatctacctcttggttggggacaacagttggaaacgactgctaatacccaatgtgccgtaaggtgaaagatttattgccaggagaggagctcgcgtctgattagctagttggtggggtaaaggcctaccaaggcatcgatcagtagctggtctgagaggatgagcagccacactgggactgagacacggcccagactcctacgggaggcagcagtggggaattttccgcaatgggcgaaagcctgacggagcaataccgcgtgagggaggaaggctcttgggttgtaaacctcttttctcagggaagaagatctgacggtacctgaggaataagcatcggctaactccgtgccagcagccgcggtaatacggagggtgcaagcgttatccggaattattgggcgtaaagcgtccgcaggtggtctttcaagtctgctgtcaaagaccgtggcttaaccacggaaaggcagtggaaactgggagactagagtccggtaggggtagcgggaattcccagtgtagcggtgaaatgcgtagatattgggaagaacatcagtggcgaaggcgcgctactgggccggaactgacactcagggacgaaagctaggggagcgaaagggattagatacccctgtagtcctagctgtaaacgatggaaactaggtgtggcttgtatcgacccgagccgtgccgaagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtcgcgaatcttgatgaaagttgagagtgccttcgggagcgcgaacacaggtggtgcatggctgtcgtcagctcgtgtcgtgagatgttgggttaagtcccgcaacgagcgcaaccctcgtccttagttgccatcattaagttgggaactctagggagactgccggtgacaaaccggaggaaggtgaggatgacgtcaagtcagcatgccccttacgccctgggcgacacacgtactacaatggttgggacaaagggcagcgaccccgcgagggagagcgaatctcatcaaacccagcctcagttcagattgcaggctgcaactcgcctgcatgaaggaggaatcgctagtaatcgcaggtcagcatactgcggtgaattcgttcccgggccttgtacacaccgcccgtcacaccatggaagctggtcacgcccgaagtagttaccctaaccttttggagggggactcctaaggcagggctagtgactggggtgaagtcgtaacaaggtagccgtaccggaaggtgtggctggatcacctcctta

SEQ ID NO: 10221 - DNA, 1486 bp, unicellular cyanobacterium SU3
  ref <308>: DATABASE ACCESSION NUMBER: NCBI ACCESSION: NZ_NETF01000086.1
  ref <309>: DATABASE ENTRY DATE: 2019-04-01
  ref <313>: RELEVANT RESIDUES IN SEQ ID NO: (1)..(1486)
cacggagagtttgatcctggctcaggatgaacgctggcggtatgcctaacacatgcaagtcgaacgaagtcttcggacttagtggcggacgggtgagtaacgcgtgagaatctgccttcaggatggggataacagtgggaaaccactgctaatacccaatatgccgaaaggtgaaaattattttgcctggagaggagctcgcgtctgattagctagttggtggggtaaaagcttaccaaggcaacgatcagtagctggtctgagaggatgagcagccacactgggactgagacacggcccagactcctacgggaggcagcagtggggaattttccgcaatgggcgaaagcctgacggagcaataccgcgtgagggaggaaggcctttgggttgtaaacctcttttctcagggaagaagatctgacggtacctgaggaataagcatcggctaactccgtgccagcagccgcggtaatacggaggatgcaagcgttatccggaattattgggcgtaaagcgtccgcaggtggtttttcaagtctgctgtcaaagaccagagctcaactctgggccggcagtggaaactgggaaactagagttcggtaggggtagcgggaattcccagtgtagcggtgaaatgcgtagatattgggaagaacaccagtggcgaaggcgcgctactggaccgaaactgacactcagggacgaaagctaggggagcgaaagggattagatacccctgtagtcctagctgtaaacgatggaaactaggtgtggcttgtatcgacccgagccgtgccgtagctaacgcgttaagtttcccgcctggggagtacgcacgcaagtgtgaaactcaaaggaattgacgggggcccgcacaagcggtggagtatgtggtttaattcgatgcaacgcgaagaaccttaccagggcttgacatgtccggaactttcctgaaagggaaaggtgccttcgggagccggaacacaggtggtgcatggctgtcgtcagctcgtgtcgtgagatgttgggttaagtcccgcaacgagcgcaaccctcgtctttagttgccagcattaaggtgggcactctagagagactgccggtgacaaaccggaggaaggtggggatgacgtcaagtcagcatgccccttacgccctgggctacacacgtactacaatggttgggacaaagggcagcgaacccgcgagggaaagcgaatctcatcaaacccagcctcagttcagattgctctctgcaactcgagagcatgaaggaggaatcgctagtaatcgcaggtcagcatactgcggtgaattcgttcccgggccttgtacacaccgcccgtcacaccatggaagctggtcacgcccgaagtagttaccctaactttcgagagggggactcctaaggcagggctagtgactggggtgaagtcgtaacaaggtagccgtaccggaaggtgtggctggatcacctccttat
